(12) United States Patent
Luo et al.

(10) Patent No.: US 11,479,782 B2
(45) Date of Patent: Oct. 25, 2022

(54) ALFALFA WITH REDUCED LIGNIN COMPOSITION

(71) Applicant: CELLECTIS, Paris (FR)

(72) Inventors: Song Luo, Chicago, IL (US); Nicholas J. Baltes, Maple Grove, MN (US)

(73) Assignee: CELLECTIS, Paris (FR)

( * ) Notice: Subject to any disclaimer, the term of this patent is extended or adjusted under 35 U.S.C. 154(b) by 173 days.

(21) Appl. No.: 16/608,060

(22) PCT Filed: Apr. 25, 2018

(86) PCT No.: PCT/IB2018/052878
§ 371 (c)(1),
(2) Date: Oct. 24, 2019

(87) PCT Pub. No.: WO2018/198049
PCT Pub. Date: Nov. 1, 2018

(65) Prior Publication Data
US 2020/0048648 A1 Feb. 13, 2020

Related U.S. Application Data

(60) Provisional application No. 62/489,647, filed on Apr. 25, 2017.

(51) Int. Cl.
C12N 15/82 (2006.01)

(52) U.S. Cl.
CPC .............................. *C12N 15/8255* (2013.01)

(58) Field of Classification Search
None
See application file for complete search history.

(56) References Cited

U.S. PATENT DOCUMENTS

| | | |
|---|---|---|
| 4,179,337 A | 12/1979 | Davis et al. |
| 4,683,195 A | 7/1987 | Mullis et al. |
| 4,761,373 A | 8/1988 | Anderson et al. |
| 4,769,061 A | 9/1988 | Comai |
| 4,810,648 A | 3/1989 | Stalker |
| 4,940,835 A | 7/1990 | Shah et al. |
| 4,959,317 A | 9/1990 | Sauer |
| 4,975,374 A | 12/1990 | Goodman et al. |
| 5,006,333 A | 4/1991 | Saifer et al. |
| 5,013,659 A | 5/1991 | Bedbrook et al. |
| 5,162,602 A | 11/1992 | Somers et al. |
| 5,204,253 A | 4/1993 | Sanford et al. |
| 5,276,268 A | 1/1994 | Strauch et al. |
| 5,356,802 A | 10/1994 | Chandrasegaran |
| 5,436,150 A | 7/1995 | Chandrasegaran |
| 5,487,994 A | 1/1996 | Chandrasegaran |
| 5,501,967 A | 3/1996 | Offringa et al. |
| 5,538,880 A | 7/1996 | Lundquist et al. |
| 5,554,798 A | 9/1996 | Lundquist et al. |
| 5,561,236 A | 10/1996 | Leemans et al. |
| 5,591,616 A | 1/1997 | Hiei et al. |
| 5,767,366 A | 6/1998 | Sathasivan et al. |
| 5,792,640 A | 8/1998 | Chandrasegaran |
| 5,879,903 A | 3/1999 | Strauch et al. |
| 5,928,937 A | 7/1999 | Kakefuda et al. |
| 6,084,155 A | 7/2000 | Volrath et al. |
| 6,326,166 B1 | 12/2001 | Pomerantz et al. |
| 6,329,571 B1 | 12/2001 | Hiei |
| 6,368,227 B1 | 4/2002 | Olson |
| 6,451,732 B1 | 9/2002 | Beckett et al. |
| 6,451,735 B1 | 9/2002 | Ottaway et al. |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,001,768 B2 | 2/2006 | Wolffe |
| 7,013,219 B2 | 3/2006 | Case et al. |
| 7,067,722 B2 | 6/2006 | Fillatti |
| 7,070,934 B2 | 7/2006 | Cox, III et al. |
| 7,163,824 B2 | 1/2007 | Cox, III et al. |
| 7,189,691 B2 | 3/2007 | Hemenway |
| 7,220,719 B2 | 5/2007 | Case et al. |
| 7,262,054 B2 | 8/2007 | Jamieson et al. |
| 7,273,923 B2 | 9/2007 | Jamieson et al. |
| 7,285,416 B2 | 10/2007 | Choo et al. |
| 7,361,635 B2 | 4/2008 | Miller et al. |
| 7,521,241 B2 | 4/2009 | Choo et al. |
| 7,842,489 B2 | 11/2010 | Arnould et al. |
| 8,420,782 B2 | 4/2013 | Bonas et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,586,363 B2 | 11/2013 | Voytas et al. |

(Continued)

FOREIGN PATENT DOCUMENTS

| | | |
|---|---|---|
| EP | 0 242 246 | 10/1987 |
| EP | 2 206 723 | 7/2010 |

(Continued)

OTHER PUBLICATIONS

Guo et al. (The Plant Cell, 13:73-88, 2001).*
Sattler et al. (Plant Science, 178:229-238, 2010).*
Sullivan et al. (GenBank Sequence Accession No. GU066087, pp. 1-3; Published Oct. 28, 2009).*
Mahfouz et al. (Plant Biotechnology Journal, 12:1006-1014, Published 2014).*
U.S. Appl. No. 61/225,043, Bonas et al., filed Jul. 13, 2009.
"TAL effector nucleases." Nature Reprint Collection [online], Oct. 2011, [retrieved on Mar. 14, 2012], Retrieved from the Internet: URL <http://www.nature.com/nbt/collections/talen/index.html>, 32 pages, Marshall (ed.).

(Continued)

*Primary Examiner* — Vinod Kumar
(74) *Attorney, Agent, or Firm* — Dicke, Billig & Czaja, PLLC

(57) ABSTRACT

Materials and methods for creating plants (e.g., alfalfa lines) with reduced lignin content and composition are provided herein, as are plants, plant parts, and plant cells generated by the methods provided herein.

4 Claims, 14 Drawing Sheets

Specification includes a Sequence Listing.

(56) References Cited

U.S. PATENT DOCUMENTS

| | | |
|---|---|---|
| 8,697,853 B2 | 4/2014 | Voytas et al. |
| 9,035,129 B2 | 5/2015 | Bilyeu et al. |
| 9,198,365 B2 | 12/2015 | Bilyeu et al. |
| 2001/0016956 A1 | 8/2001 | Ward et al. |
| 2005/0064474 A1 | 3/2005 | Umov et al. |
| 2007/0141038 A1 | 6/2007 | Choulika et al. |
| 2009/0060921 A1 | 3/2009 | Dickey et al. |
| 2009/0133158 A1 | 5/2009 | Lahaye et al. |
| 2009/0271881 A1 | 10/2009 | Arnould et al. |
| 2009/0305402 A1 | 12/2009 | Liljedahl et al. |
| 2010/0132069 A1 | 5/2010 | Lahaye et al. |
| 2010/0154081 A1 | 6/2010 | Weterings et al. |
| 2010/0175144 A1 | 7/2010 | Swaller |
| 2011/0041195 A1 | 2/2011 | Doyon |
| 2011/0129898 A1 | 6/2011 | Doyon et al. |
| 2011/0136895 A1 | 6/2011 | Gregory et al. |
| 2011/0145940 A1 | 6/2011 | Voytas et al. |
| 2011/0158957 A1 | 6/2011 | Bonini et al. |
| 2011/0167521 A1 | 7/2011 | Dekelver et al. |
| 2011/0201055 A1 | 8/2011 | Doyon et al. |
| 2011/0201118 A1 | 8/2011 | Yang et al. |
| 2011/0203012 A1 | 8/2011 | Dotson et al. |
| 2011/0207221 A1 | 8/2011 | Cost et al. |
| 2011/0239315 A1 | 9/2011 | Bonas et al. |
| 2011/0247089 A1 | 10/2011 | Doyon |
| 2011/0265198 A1 | 10/2011 | Gregory et al. |
| 2011/0269234 A1 | 11/2011 | Doyon et al. |
| 2011/0287545 A1 | 11/2011 | Cost et al. |
| 2011/0301073 A1 | 12/2011 | Gregory et al. |
| 2012/0047600 A1* | 2/2012 | Zhou .................. C12N 15/8255 800/278 |
| 2012/0110685 A1 | 5/2012 | Bonas et al. |
| 2012/0122205 A1 | 5/2012 | Bonas et al. |
| 2012/0178131 A1 | 7/2012 | Voytas et al. |
| 2012/0178169 A1 | 7/2012 | Voytas et al. |
| 2012/0214228 A1 | 8/2012 | Voytas et al. |
| 2012/0246764 A1 | 9/2012 | Hlubek et al. |
| 2012/0284877 A1 | 11/2012 | Hlubek et al. |
| 2012/0324603 A1 | 12/2012 | Hlubek et al. |
| 2013/0122581 A1 | 5/2013 | Voytas et al. |
| 2014/0090116 A1 | 3/2014 | Ainley et al. |
| 2015/0218573 A1 | 8/2015 | Loque |

FOREIGN PATENT DOCUMENTS

| | | | |
|---|---|---|---|
| EP | 2 392 208 | 12/2011 | |
| EP | 2 562 260 | 2/2013 | |
| WO | WO 1994/18313 | 8/1994 | |
| WO | WO 1995/09233 | 4/1995 | |
| WO | WO 2001/073090 | 10/2001 | |
| WO | WO-0173090 A2 * | 10/2001 | ......... C12N 15/8255 |
| WO | WO 2004/067736 | 8/2004 | |
| WO | WO 2007/060495 | 5/2007 | |
| WO | WO 2008/141806 | 11/2008 | |
| WO | WO 2009/095793 | 8/2009 | |
| WO | WO 2010/079430 | 7/2010 | |
| WO | WO 2010/091018 | 8/2010 | |
| WO | WO 2010/145846 | 12/2010 | |
| WO | WO 2011/005998 | 1/2011 | |
| WO | WO 2011/017293 | 2/2011 | |
| WO | WO 2011/019385 | 2/2011 | |
| WO | WO 2011/072246 | 6/2011 | |
| WO | WO 2011/100058 | 8/2011 | |
| WO | WO 2011/117249 | 9/2011 | |
| WO | WO 2011/146121 | 11/2011 | |
| WO | WO 2011/154393 | 12/2011 | |
| WO | WO 2012/106105 | 8/2012 | |
| WO | WO 2013/050155 | 4/2013 | |
| WO | WO 2014/039692 | 3/2014 | |
| WO | WO 2014/039702 | 3/2014 | |
| WO | WO 2015/168158 | 11/2015 | |
| WO | WO-2015168158 A1 * | 11/2015 | ......... C12N 15/8255 |

OTHER PUBLICATIONS

Alam and Sittman, "Characterization of the cytotoxic effect of a chimeric restriction enzyme. H1 °-FokI," Gene. Ther. Mol. Biol., 10:147-160, 2006.

Alam, "Characterization of the cytotoxic effect of a novel chimeric restriction nuclease, H1 °-FokI, in mouse fibroblast cells: Implications for chromatin mapping and gene therapy studies." Ph.D. Thesis, The University of Mississippi Medical Center, 223 pages, 2006.

Al-Saadi et al., "All five host-range variants of Xanthomonas citri carry one pthA homolog with 17.5 repeats that determines pathogenicity on citrus, but none determine host-range variation," Mol. Plant Microbe Interact, 20(8):934-943, Aug. 2007.

Antony et al., "Rice xa13 recessive resistance to bacterial blight is defeated by induction of the disease susceptibility gene Os-11N3," Plant Cell, 22(11):3864-3876, Nov. 2010.

Antony, "Molecular basis of avrXa7 mediated virulence in bacterial blight of rice," [abstract of dissertation] Kansas State University, 99 pages, 2010.

Arimondo et al., "Exploring the cellular activity of camptothecin-triple-helix-forming oligonucleotide conjugates," Mol. Cell Biol., 26(1):324-333, Jan. 2006.

Atanassov et al., "Plant regeneration from suspension culture and mesophyll protoplasts of *Medicago sativa* L.," Plant Cell, Tissue and Organ Culture, 3: 149-162, 1984.

Athinuwat et al., "Xanthomonas axonopodis pv. glycines soybean cultivar virulence specificity is determined by avrBs3 homolog avrXgl," Phytopathology, 99(8):996-1004, Aug. 2009.

Bai et al., "Xanthomonas oryzae pv. oryzae avirulence genes contribute differently and specifically to pathogen aggressiveness," Mol. Plant Microbe Interact, 13(12):1322-1329, Dec. 2000.

Baker, "Gene-editing nucleases," Nature Methods, 9(4):23-26, Jan. 2012.

Ballvora et al., "Genetic mapping and functional analysis of the tomato Bs4 locus governing recognition of the Xanthomonas campestris pv. vesicatoria AvrBs4 protein," Mol. Plant Microbe Interact, 14(5):629-638, May 2001.

Belhaj et al., "Plant genome editing made easy: targeted mutagenesis in model and crop plants using the CRISPR/Cas system," Plant Methods, 9(1):39, Dec. 2013.

Beretta et al., "Tethering a type IB topoisomerase to a DNA site by enzyme fusion to a heterologous site-selective DNA-binding protein domain," Cancer Res., 59(15):3689-3697, Aug. 1999.

Bethke and Busse, "Validation of a simple, colorimetric, microplate assay using amplex red for the determination of glucose and sucrose in potato tubers and other vegetables." Am. J. Pot Res., 85(6)414-421, Dec. 2008.

Beuselinek et al., "An Assessment of Phenotype Selection for Linolenic Acid Using Genetic Markers," Crop Sci., 46(2):747-750, Mar. 2006.

Bhaskar et al., "Suppression of the vacuolar invertase gene prevents cold-induced sweetening in potato," Plant Physiol., 154(2):939-948, Oct. 2010.

Bibikova et al., "Enhancing gene targeting with designed zinc finger nucleases," Science, 300(5620):764, May 2003.

Bibikova et al., "Stimulation of homologous recombination through targeted cleavage by chimeric nucleases," Mol. Cell Biol., 21(1):89-297, Jan. 2001.

Bitinaite et al., "FokI dimerization is required for DNA cleavage," Proc. Natl. Acad. Sci. USA, 95(18):10570-10575, Sep. 1998.

Boch and Bonas, "Xanthomonas AvrBs3 family-type III effectors: discovery and function," Annu. Rev. Phytopathol., 48:419-436, Sep. 2010.

Boch et al., "Breaking the code of DNA binding specificity of TAL-type III effectors," Science, 326(5959):1509-1512, Dec. 2009.

Boch et al., "Molecular characterization of three AvrBs3-like effectors from the *Arabidopsis pathogen* Xanthomonas campestris pv. armoraciae," (abstract), XIV International Congress on Molecular Plant-Microbe Interactions, Quebec City, Canada, Jul. 19-23, 2009, 2 pages.

Bogdanove and Voytas, "TAL effectors: Customizable Proteins for DNA Targeting," Science, 333(6051):1843-1846, Sep. 2011.

(56) References Cited

OTHER PUBLICATIONS

Bogdanove et al., "TAL effectors: finding plant genes for disease and defense," Curr. Opin. Plant Biol., 13(4):394-401, Aug. 2010.
Boller and He, "Innate immunity in plants: an arms race between pattern recognition receptors in plants and effectors in microbial pathogens," Science, 324(5928):742-744, May 2009.
Bonas et al., "Genetic and structural characterization of the avirulence gene avrBs3 from Xanthomonas campestris pv. vesicatoria," Mol. Gen. Genet., 218(1):127-136, Jul. 1989.
Bonas et al., "How the bacterial plant pathogen Xanthomonas campestris pv. vesicatoria conquers the host," Mol. Plant Pathol., 1(1):73-76, Jan. 2000.
Bonas et al., "Resistance in tomato to Xanthomonas campestris pv vesicatoria is determined by alleles of the pepper-specific avirulence gene avrBs3," Mol. Gen. Genet., 238(1-2):261-269, Apr. 1993.
Bonas, "How Xanthomonas manipulates the plant cell," (abstract), XIV International Congress on Molecular Plant-Microbe Interactions, Quebec City, Canada, Jul. 19-23, 2009, 2 pages.
Borevitz et al., "Activation tagging identifies a conserved MYB regulator of phenylpropanoid biosynthesis," Plant Cell, 12(12):2383-2394, Dec. 2000.
Busk et al., "Regulatory elements in vivo in the promoter of the abscisic acid responsive gene rab17 from maize," Plant J., 11(6):1285-1295, Dec. 1997.
Büttner and Bonas, "Getting across—bacterial type III effector proteins on their way to the plant cell," EMBO J., 21(20):5313-5322, Oct. 2002.
Büttner et al., "Functional analysis of HrpF, a putative type III translocon protein from Xanthomonas campestris pv. vesicatoria," J. Bacteriol., 184(9):2389-2398, May 2002.
Büttner et al., "HpaB from Xanthomonas campestris pv. vesicatoria acts as an exit control protein in type III-dependent protein secretion," Mol. Microbiol., 54(3):755-768, Nov. 2004.
Büttner et al., "Targeting of two effector protein classes to the type III secretion system by a HpaC- and HpaB-dependent protein complex from Xanthomonas campestris pv. vesicatoria," Mol. Microbiol., 59(2):513-527, Jan. 2006.
Canteros el al., "A Gene from Xanthomonas campestris pv. vesicatoria that Determines," Mol. Plant Microbe Interact., 4(6):628-632, Aug. 1991.
Carlson et al., "Targeting DNA with fingers and TALENs," Mol. Ther. Nucl. Acids, 1:1-4, Jan. 2012.
Cathomen and Joung, "Zinc-finger nucleases: the next generation emerges," Mol. Ther., 16(7):1200-1207, Jul. 2008.
Cavalier et al., "Disrupting two Arabidopsis thaliana xylosyltransferase genes results in plants deficient in xyloglucan, a major primary cell wall component," The Plant Cell, 20(6):1519-1537, Jun. 2008.
Cermak et al., "Efficient design and assembly of custom TALEN and other TAL effector-based constructs for DNA targeting," Nucleic Acids Res., 39(12):e82, Jul. 2011.
Cermak et al., Poster and Abstract—"Engineered TAL effector nucleases: new tools for genome editing," Northwest Genome Engineering Consortium Workshop on Genome Engineering, 3 pages, 2010.
Chevalier et al., "Design, activity, and structure of a highly specific artificial endonuclease," Mol. Cell, 10(4):895-905, Oct. 2002.
Choo et al., "In vivo repression by a site-specific DNA-binding protein designed against an oncogenic sequences," Nature, 372(6507):642-645, Dec. 1994.
Choulika et al., "Induction of homologous recombination in mammalian chromosomes by using the I-Scel system of Saccharomyces cerevisiae," Mol Cell Biol, 15(4):1968-1973, Apr. 1995.
Christian et al., "Targeting DNA double-strand breaks with TAL effector nucleases," Genetics, 186(2):757-761, Oct. 2010.
Christian et al., Poster and Abstract—"Fusions of TAL effectors to the FokI endonuclease confer site specificity in DNA cleavage," IAPB 12th World Congress and In Vitro Biology Meeting, 4 pages, Jun. 2010.
Cole et al., "The Jpred 3 secondary structure prediction server," Nucl. Acids Res., 36(Suppl_2):W197-W201, May 2008.
Cornelis, "The type III secretion injectisome," Nat. Rev. Microbiol., 4(11):811-825, Nov. 2006.
Curtin et al., "Targeted mutagenesis of duplicated genes in soybean with zinc-finger nucleases," Plant Physiology, 156(2):466-473, June 2011.
De Feyter et al., "Gene-for genes interactions between cotton R genes and Xanthomonas campestris pv. malvacearum avr genes," Mol. Plant Microbe Interact, 6(2):225-237, Mar.-Apr. 1993.
DeFrancesco, "Move over ZFNs," Nat. Biotechnol., 29(8):681-684, Aug. 2011.
Desjarlais and Berg, "Toward rules relating zinc finger protein sequences and DNA binding site preferences," Proc. Natl. Acad. Sci. USA, 89(16):7345-7349, Aug. 1992.
Domingues et al., "The Xanthomonas citri effector protein PthA interacts with citrus proteins involved in nuclear transport, protein folding and ubiquitination associated with DNA repair," Mol. Plant Pathol., 11 (5):663-675, Sep. 2010.
Doyle et al., "TAL Effector-Nucleotide Targeter (TALE-NT) 2.0: tools for TAL effector design and target prediction," Nucleic Acids Res., 40(W1):W117-22, Jul. 2012.
Draffehn et al., "Natural diversity of potato (Solanum tuberosum) invertases," BMC Plant Biol., 10(271):1-15, Dec. 2010.
Durai et al., "Zinc finger nucleases: custom-designed molecular scissors for genome engineering of plant and mammalian cells," Nucl. Acids Res., 33(18):5978-5990, Jan. 2005.
Eisenschmidt et al., "Developing a programmed restriction endonuclease for highly specific DNA cleavage," Nucl. Acids Res., 33(22):7039-7047, Jan. 2005.
Engler et al., "A One Pot, One Step, Precision Cloning Method with High Throughput Capability," PLoS One, 3(11):e3647, Nov. 2008.
Engler et al., "Golden Gate Shuffling: A One-Pot DNA Shuffling Method Based on Type IIs Restriction Enzymes," PLoS One, 4(5):e5553, May 2009.
Fajardo-Sanchez et al., "Computer design of obligate heterodimer meganucleases allows efficient culling of custom DNA sequences," Nucl. Acids Res. 36(7)-2163-2173, Apr. 2008.
Foley et al., "Rapid Mutation of Endogenous Zebrafish Genes Using Zinc Finger Nucleases Made by Oligomerized Pool ENgineering (OPEN)," PLoS One, 4(2):e4348, Feb. 2009.
Fonfara et al., "Creating highly specific nucleases by fusion of active restriction endonucleases and catalytically inactive homing endonucleases," Nucl. Acids Res., 40(2):847-860, Jan. 2012.
Foster et al., "Comprehensive compositional analysis of plant cell walls (Lignocellulosic biomass) part I: lignin," J Vis Exp, 37: 5-8, 2010.
Fujikawa et al., "Suppression of defense response in plants by the avrBs3/pthA gene family of Xanthomonas spp.," Mol. Plant Microbe Interact, 19(3):342-349, Mar. 2006.
Fukushima and Hatfield, "Comparison of the acetyl bromide spectrophotometric method with other analytical lignin methods for determining lignin concentration in forage samples," J Agri Food Chem, 52: 3713-3720, 2004.
Gabriel et al., "An unbiased genome-wide analysis of zinc-finger nuclease specificity," Nat. Biotechnol., 29(9):816-82.3, Sep. 2011.
Geißler et al., "Transcriptional activators of human genes with programmable DNA-specificity," PLoS One, 6(5):e19509, May 2011.
GenBank Accession No. AAT46122.1, "avirulence protein AvrXa7-1M [Xanthomonas oryzae pv. oryzae]," Nov. 12, 2004, 2 pages.
GenBank Accession No. ACD58243.1, "TAL effector AvrBs3/PthA [Xanthomonas oryzae pv. oryzae PXO99A]," May 19, 2008, 2 pages.
GenBank Accession No. AY986492.1, "*Oryza sativa* (indica cultivar-group) Xa27 (Xa27) gene, Xa27-IRBB27 allele, complete cds," Jun. 24, 2005, 2 pages.
GenBank Accession No. CP000967.1, "Xanthomonas oryzae pv. oryzae PXO99A, complete genome," May 19, 2008, 606 pages.
GenBank Accession No. J04623.1, "F. okeanokoites methylase (MFokI) and endonuclease (RFokI) genes, complete cds," Apr. 26, 1993, 2 pages.
GenBank Accession No. M28828.1. "F.okeanokoites fokIR and fokIM genes encoding endonuclease and methyltransferase, complete cds," Apr. 26, 1993, 3 pages.

(56) References Cited

OTHER PUBLICATIONS

GenBank Accession No. P14727.2, "RecName: Full=Avirulence protein AvrBs3; AltName: Full=TAL effector protein AvrBs3," Jun. 28, 2011, 3 pages.
GenBank Accession No. X16130.1, "Xanthomonas vesicatoria plasmid pXV11 avrBs3 gene for avirulence protein avrBs3," Oct. 15, 2007, 3 pages.
GenBank Accession No. GU066087.1, "Medicago sativa S-adenosyl-L-methionine: caffeic acid 3-0-methyltransferase (COMT) mRNA, complete cds", Oct. 28, 2009.
Göhre and Robatzek, "Breaking the barriers: microbial effector molecules subvert plant immunity," Ann. Rev. Phytopathol., 46:189-215, Sep. 2008.
Gonchar et al., PspXI, a novel restriction endonuclease that recognizes the unusual DNA sequence 5'-VC1TCGAGB-3', Bulletin of biotechnology and physico-chemical biology, 1(1):18-24, 2005, Translation by Ovchinnikov, "Science sibenzyme.com" [online], [retrieved on Aug. 11, 2011]. Retrieved from the Internet: URL: <http://science.sibenzyme.com/article8_article_3_1.phtml>, 4 pages.
Gonzalez et al., "Molecular and pathotypic characterization of new Xanthomonas oryzae strains from West Africa," Mol. Plant Microbe. Interact., 20(5):534-546, May 2007.
Govindarajulu et al., "Evaluation of constitutive viral promoters in transgenic soybean roots and nodules," Mol. Plant Microbe Interact, 21(8):1027-1035, Aug. 2008.
Greiner et al. "Ectopic expression of a tobacco invertase inhibitor homolog prevents cold-induced sweetening of potato tubers," Nature Biotechnology, 17(7):708-711, Jul. 1999.
Greisman and Pabo, "A general strategy for selecting high-affinity zinc finger proteins for diverse DNA target sites," Science, 275(5300):657-661, Jan. 1997.
Gu et al., "R gene expression induced by a type-III effector triggers disease resistance in rice," Nature, 435(7045):1122-1125, Jun. 2005.
Gu et al., "Transcription activator-like type III effector AvrXa27 depends on OsTFIIAγS for the activation of Xa27 transcription in rice that triggers disease resistance to Xanthomonas oryzae. pv. oryzae," Mol. Plant Pathol., 10(6):829-835, Nov. 2009.
Guan et al., "Heritable endogenous gene regulation in plants with designed polydactyl zinc finger transcription factors," Proc Natl Acad Sci USA, 99(20):13296-13301, Oct. 2002.
Guo et al., "Downregulation of caffeic acid 3-O-methyltransferase and caffeoyl CoA 3-O-methyltransferase in transgenic alfalfa. impacts on lignin structure and implications for the biosynthesis of G and S lignin," Plant Cell, 13: 73-88, 2001.
Gürlebeck et al., "Dimerization of the bacterial effector protein AvrBs3 in the plant cell cytoplasm prior to nuclear import," Plant J., 42(2):175-187, Apr. 2005.
Gürlebeck et al., "Type III effector proteins from the plant pathogen Xanthomonas and their role in the interaction with the host plant," J. Plant Physiol, 163(3):233-255, Feb. 2006.
Gürlebeck et al., "Visualization of novel virulence activities of the Xanthomonas type III effectors AvrBsl, AvrBs3 and AvrBs4," Mol. Plant Pathol., 10(2):175-188, Mar. 2009.
Haber, "In vivo biochemistry: physical monitoring of recombination induced by site-specific endonucleases," Bioessays, 17(7):609-620, Jul. 1995.
Haberlach et al., "Isolation, culture and regeneration of protoplasts from potato and several related Solanum species," Plant Science, 39(1):67-74 May 1985.
Hahn et al., "New mechanistic insights into the virulence activity of the Xanthomonas type III effector AvrBs3," (abstract), XIV International Congress on Molecular Plant-Microbe Interactions, Quebec City, Canada, Jul. 19-23, 2009, 2 pages.
Halford et al., "The reaction mechanism of FokI excludes the possibility of targeting zinc finger nucleases to unique DNA sites," Biochem. Soc. Trans., 39(2):584-588, Apr. 2011.
Händel et al., "Expanding or restricting the target site repertoire of zinc-finger nucleases: the inter-domain linker as a major determinant of target site selectivity." Mol. Ther., 17(1):104-111, Jan. 2009.
Hatfield and Fukushima, "Can lignin be accurately measured?," Crop Science, 45: 832-839, 2005.
Haun et al., "Improved soybean oil quality by targeted mutagenesis of fatty acid desaturase 2 gene family," Plant Biotechnology Journal, 12(7):934-40, Sep. 2014.
Herbers et al., "Race-specificity of plant resistance to bacterial spot disease determined bv repetitive motifs in a bacterial avirulence protein," Nature, 356(6365):172-174, Mar. 1992.
Heuer et al., "Repeat domain diversity of avrBs3-like genes in Ralstonia solanacearum strains and association with host preferences in the field," Appl. Environ. Microbiol., 73(13):4379-4384, Jul. 2007.
Hockemeyer et al., "Genetic engineering of human pluripotent cells using TALE nucleases," Nat. Biotechnol., 29(8):731-734, Aug. 2011.
Hopkins et al., "Identification of a Family of Avirulence Genes From Xanthomonas Oryzae Pv. Oryzae," Mol. Plant Microbe Interact, 5(6):451-459, Nov.-Dec. 1992.
Hu et al., "A virulence gene and insertion element-based RFLP as well as RAPD markers reveal high levels of genomic polymorphism in the rice pathogen Xanthomonas oryzae pv. oryzae," Syst. Appl. Microbiol., 30(8):587-600, Dec. 2007.
Huang et al., "Heritable gene targeting in zebrafish using customized TALENs," Nat. Biotechnol., 29(8):699-700, Aug. 2011.
Hummel et al., "Rice gene activation by transcription activator-like effectors of Xanthomonas oryzae pvs. oryzae and oryzicola," poster presentation, and "A cipher-like mechanism governs TAL effector-DNA recognition," poster #13-517, XIV International Congress on Molecular Plant-Microbe Interactions, Quebec City, Canada, 3 pages, Jul. 19-23, 2009.
Hurt et al., "Highly specific zinc finger proteins obtained by directed domain shuffling and cell-based selection," Proc. Natl. Acad. Sci. USA, 100(21):12271-12276, Oct. 2003.
International Search Report and Written Opinion in International Application No. PCT/TB2018/052878, dated Jul. 27, 2018.
Isalan et al., "A rapid, generally applicable method to engineer zinc fingers illustrated by targeting the HIV-1 promoter," Nat. Biotechnol., 19(7):656-660, Jul. 2001.
Jäckel et al., "Protein Design by Directed Evolution," Annu. Rev. Biophvs., 37:155-173, 2008.
Johnson et al., "Regeneration of alfalfa plants from protoplasts of selected Regen S clones," Plant Sciences Letters, 20(4):297-304, 1981.
Jones and Dangl, "The plant immune system," Nature, 444(7117):323-329, Nov. 2006.
Jordan et al., "Physical delimitation of the pepper Bs3 resistance gene specifying recognition of the AvrBs3 protein from Xanthomonas campestris pv. vesicatoria," Theor. Appl. Genet., 113(5):895-905, Sep. 2006.
Kao et al., "Plant regeneration from mesophyll protoplasts of alfalfa," Zeitschrift für Pflanzenphysiologie, 96: 135-141, 1980.
Kay and Bonas, "How Xanthomonas type III effectors manipulate the host plant," Curr. Opin Microbiol., 12(1):37-43, Feb. 2009.
Kay et al., "A bacterial effector acts as a plant transcription factor and induces a cell size regulator," Science 318: 648-651, 2007.
Kay et al., "A bacterial effector acts as a plant transcription factor and induces a cell size regulator," Science, 318(5850):648-651, Oct. 2007.
Kay et al., "Characterization of AvrBs3-like effectors from a Brassicaceae pathogen reveals virulence and avirulence activities and a protein with a novel repeat architecture," Mol. Plant Microbe Interact, 18(8):838-848, Aug. 2005.
Kay et al., "Detailed analysis of the DNA recognition motifs of the Xanthomonas type III effectors AvrBs3 and AvrBs3Δrep16," Plant J, 59(6):859-871, Sep. 2009.
Keshavarzi et al., "Basal defenses induced in pepper by lipopolysaccharides are suppressed by Xanthomonas campestris pv. vesicatoria," Mol. Plant Microbe Interact, 17(7):805-815, Jul. 2004.
Kim and Chandrasegaran, "Chimeric restriction endonuclease." Proc. Natl. Acad. Sci. USA, 91(3):883-887, Feb. 1994.
Kim et al., "Comparative analysis of three indigenous plasmids from Xanthomonas axonopodis pv. glycines," Plasmid, 56(2):79-87, Sep. 2006.

(56) References Cited

OTHER PUBLICATIONS

Kim et al., "Construction of a Z-DNA-specific restriction endonuclease," Proc. Natl. Acad. Sci. USA, 94(24):12875-12879, Nov. 1997.
Kim et al., "Hybrid restriction enzymes: zinc finger fusions to FokI cleavage," Proc. Natl. Acad. Sci. USA, 93(3):1156-1160, Feb. 1996.
Kim et al., "Site-specific cleavage of DNA-RNA hybrids by zinc finger/FokI cleavage domain fusions," Gene, 203(1):43-49, Dec. 1997.
Kim et al., "Targeted genome editing in human cells with zinc finger nucleases constructed via modular assembly," Genome Res., 19(7):1279-1288, Jul. 2009.
Knoop et al., "Expression of avirulence gene avrBs3 from Xanthomonas campestris pv. vesicatoria is not under the control of hrp genes and is independent of plant factors," J. Bacteriol., 173(22):7142-7150, Nov. 1991.
Lahaye and Bonas, "Molecular secrets of bacterial type III effector proteins," Trends Plant Sci., 6(10):479-485, Oct. 2001.
Ledford, "Plant genes get fine tailoring," Nature News [online], Apr. 29, 2009 [retrieved on May 21, 2009], Retrieved from the Internet: <URL: http://www.nature.com/news/2009/090429/full/news.2009.415.html>, 3 pages.
Lee et al., "Environmental effects on oleic acid in soybean seed oil of plant introductions with elevated oleic concentration," Crop Science, 49(5):1762-1768, Sep. 2009.
Li et al., "Functional domains in FokI restriction endonuclease," Proc. Natl. Acad. Sci. USA, 89(10):4275-4279, May 1992.
Li et al., "Modularly assembled designed TAL effector nucleases for targeted gene knockout and gene replacement in eukaryotes," Nucl. Acids Res., 39(14):6315-6325, Aug. 2011.
Li et al., "TAL nucleases (TALNs): hybrid proteins composed of TAL effectors and FokI DNA-cleavage domain," Nucleic Acids Res., 39(1):359-372, Jan. 2011.
Liang et al., "Cloning and characterization of a novel avirulence gene (arp3) from Xanthomonas oryzae pv. oryzae," DNA Seq., 15(2):110-117, Apr. 2004.
Lin and Dence, "5.1 Ultraviolet Spectrophotometry", Methods in Lignin Chemistry, 217-232, 1992.
Liu et al., "Design of polydactyl zinc-finger proteins for unique addressing within complex genomes," Proc. Natl. Acad. Sci. USA, 94(11):5525-5530, May 1997.
Livak and Schmittgen. "Analysis of relative gene expression data using real-time quantitative PCR and the 2(-Delta Delta C(T)) Method," Method. Methods, 25(4):402-408, Dec. 2001.
Luo et al., "Non-transgenic plant, genome editing using purified sequence-specific nucleases," Molecular plant, 8(9): 1425-7, 2015.
Mahfouz et al., "De novo-engineered transcription activator-like effector (TALE) hybrid nuclease with novel DNA binding specificity creates double-strand breaks," Proc. Natl. Acad. Sci. USA, 108(6):2623-2628, Feb. 2011.
Mahfouz et al., "TALE nucleases and next generation GM crops," GM Crops, 2(2):99-103, Apr. 2011.
Mak, "Sequence-specific DNA-binding TALEs," Nat. Biotechnol., 29(1):43, Jan. 2011.
Marois et al., "The Xanthomonas type III effector protein AvrBs3 modulates plant gene expression and induces cell hypertrophy in the susceptible host," Mol. Plant Microbe Interact, 15(7):637-646, Jul. 2002.
Miller et al., "A TALE nuclease architecture for efficient genome editing," Nat. Biotechnol., 29(2):143-148, Feb. 2011.
Miller et al., "An improved zinc-finger nuclease architecture for highly specific genome editing," Nature Biotechnol., 25(7):778-785, Jul. 2007.
Miuczuk et al., "Development of a single-chain, quasi-dimeric zinc-finger nuclease for the selective degradation of mutated human mitochondrial DNA," Nucleic Acids Res., 36(12):3926-3938, Jul. 2008.
Mino et al. "Efficient double-stranded DNA cleavage by artificial zinc-finger nucleases composed of one zinc-finger protein and a single-chain FokI dimer," J. Biotechnol., 140(3-4):156-161, Mar. 2009.

Mitra and Loque, "Histochemical staining of *Arabidopsis thaliana* secondary cell wall elements," J Vis Exp., 87: 51381, 11 pages, 2014.
Monteiro et al., "Plant regeneration from protoplasts of alfalfa (Medicago sativa) via somatic embryogenesis," Scientia Agricola, 60: 683-689, 2003.
Moore et al., "Transactivated and chemically inducible gene expression in plants," Plant J., 45(4):651-683, Feb. 2006.
Morbitzer et al., "Assembly of custom TALE-type DNA binding domains by modular cloning," Nucleic Acids Res., 39(13):5790-5799, Jul. 2011.
Morbitzer et al., "Regulation of selected genome loci using de novo-engineered transcription activator-like effector (TALE)-type transcription factors," Proc. Natl. Acad. Sci. USA., 107(50):21617-21622, Dec. 2010.
Moscou and Bogdanove, "A Simple Cipher Governs DNA Recognition by TAL Effectors," Science, 326(5959):1501, Dec. 2009.
Murakami et al., "The repeat domain of the type III effector protein PthA shows a TPR-like structure and undergoes conformational changes upon DNA interaction," Proteins, 78(16):3386-3395, Dec. 2010.
Murray and Thompson, "Rapid isolation of high molecular weight plant DNA," Nucl. Acids. Res., 8(19):4321-4325, Oct. 1980.
Mussolino et al., "A novel TALE nuclease scaffold enables high genome editing activity in combination with low toxicity," Nucleic Acids Res., 39(21):9283-9293, Nov. 2011.
Nakagawa et al., "Development of series of gateway binary vectors, pGWBs, for realizing efficient construction of fusion genes for plant transformation," J. Biosci. Bioeng., 104(1):34-41, Jul. 2007.
Nino-Liu et al., "Xanthomonas oryzae pathovars: model pathogens of a model crop," Mol. Plant Pathol., 7(5):303-324, Sep. 2006.
Nissan et ai., "The type III effectors HsvG and HsvB of gall-forming Pantoea agglomerans determine host specificity and function as transcriptional activators," Molecular Microbiology, 61(5):1118-1131, Sep. 2006.
Noël et al., "XopC and XopJ, two novel type III effector proteins from Xanthomonas campestris pv. vesicatoria," J. Bacteriol., 185(24):7092-7102, Dec. 2003.
Ovchinnikov et al., "PspXI, a novel restriction endonuclease that recognizes the unusual DNA sequence 5-VCTCGAGB-3," Bull Biotech. Physio-Chemical Biol., 2005, 1(1):18-24, retrieved from the Internet: http://science.sibenzyme.com/article8_article_3_1.phtml.
Padidam, "Chemically regulated gene expression in plants," Curr. Opin. Plant Biol., 6(2):169-177, Apr. 2003.
Pâques and Duchateau, "Meganucleases and DNA double-strand break-induced recombination: perspectives for gene therapy," Curr. Gene Ther., 7(1):49-66, Feb. 2007.
Park et al., "Avirulence gene diversity of Xanthomonas axonopodis pv. glycines isolated in Korea," J. Microbiol. Biotechnol., 18(9):1500-1509, Sep. 2008.
Pattanayak et al., "Revealing off-target cleavage specificities of zinc-finger nucleases by in vitro selection," Nat. Methods, 8(9):765-770, Sep. 2011.
Paulus et al., "Silencing β1, 2-xylosyltransferase in transgenic tomato fruits reveals xylose as constitutive component of IgE-binding epitopes." Frontiers in Plant Science, 2(42):1-12, Aug. 2011.
Pavletich and Pabo, "Zinc finger-DNA recognition: crvstal structure of a Zif268-DNA complex at 2.1 A," Science, 252(5007):809-817, May 1991.
Pearson, "The fate of fingers: proteins with 'zinc fingers' designed to bind almost any DNA sequence will soon be available to any lab that wants them—from two very different sources. Helen Pearson reports on a revolution in designer biology," Nature, 455(7210):160-165, Sep. 2008.
Pennisi, "The tale of the TALEs," Science, 338(6113):1408-1411, Dec. 2012.
Pham et al., "Mutant alleles of FAD2-1A and FAD2-1B combine to produce soybeans with the high oleic acid seed oil trait.," BMC Plant Biol., 10(1):195, Dec. 2010.
Pingoud and Silva, "Precision genome surgery," Nature Biotechnol., 25(7):743-744, Jul. 2007.

(56) References Cited

OTHER PUBLICATIONS

Podhajska and Szybalski, "Conversion of the FokI endonuclease to a universal restriction enzyme: cleavage of phage M13mp7 DNA at predetermined sites." Gene, 40(2-3):175-182, Jan. 1985.
Pomerantz et al., "Structure-based design of transcription factors," Science, 267(5194):93-96, Jan. 1995.
Porteus and Baltimore, "Chimeric Nucleases Stimulate Gene Targeting in Human Cells," Science, 300(5620):763, May 2003.
Porteus and Carroll, "Gene targeting using zinc finger nucleases," Nature Biotechnol., 23(8):967-973, Aug. 2005.
Porteus, "Zinc fingers on target," Nature, 459(7245):337-338, May 2009.
Potenza et al., "Targeting transgene expression in research, agricultural, and environmental applications: promoters used in plant transformation," In vitro Cell Dev. Biol., 40(1):1-22, Jan. 2004.
Puchta et al., "Homologous recombination in plant cells is enhanced by in vivo induction of double strand breaks into DNA by a site-specific endonuclease," Nucl. Acids Res., 21(22):5034-5040, Nov. 1993.
Radecke et al., "Zinc-finger nuclease-induced gene repair with oligodeoxynucleotides: wanted and unwanted target locus modifications," Mol. Ther., 18(4):743-753, Apr. 2010.
Reyon et al., "FLASH assembly of TALENs for high-throughput genome editing," Nat. Biotechnol., 30(5):460-165, May 2012.
Römer et al., "Plant pathogen recognition mediated by promoter activation of the pepper Bs3 resistance gene," Science, 318(5850):645-648, Oct. 2007.
Romer et al., "A single plant resistance gene promoter engineered to recognize multiple TAL effectors from disparate pathogens," Proc. Natl. Acad. Sci. USA, 106(48):20526-31, Dec. 2009.
Romer et al., "Promoter elements of rice susceptibility genes are bound and activated by specific TAL effectors from the bacterial blight pathogen, Xanthomonas oryzae pv. oryzae," New Phytol., 187(4):1048-1057, Sep. 2010.
Römer et al., "Recognition of AvrBs3-Like Proteins Is Mediated by Specific Binding to Promoters of Matching Pepper Bs3 Alleles," Plant Physiol., 150(4):1697-1712, Aug. 2009.
Romero et al., "Temperature sensitivity of the hypersensitive response of bell pepper to Xanthomonas axonopodis pv. vesicatoria," Phytopathology, 92(2):197-203, Feb. 2002.
Rossier et al., "HrpB2 and HrpF from Xanthomonas are type III-secreted proteins and essential for pathogenicity and recognition by the host plant," Mol. Microbiol., 38(4):828-838, Nov. 2000.
Rossier et al., "The Xanthomonas Hrp type III system secretes proteins from plant and mammalian bacterial pathogens," Proc. Natl. Acad. Sci. USA, 96(16):9368-9373, Aug. 1999.
Rouet et al., "Expression of a site-specific endonuclease stimulates homologous recombination in mammalian cells," Proc. Natl. Acad. Sci. USA, 91(13):6064-6068, Jun. 1994.
Rouet et al., "Introduction of double-strand breaks into the genome of mouse cells by expression of a rare-cutting endonuclease," Mol. Cell Biol., 14(12):8096-8106, Dec. 1994.
Rybak et al., "Identification of Xanthomonas citri ssp. citri host speciiicily genes in a heterologous expression host," Mol. Plant Pathol., 10(2):249-262, Mar. 2009.
Sandhu et al., "Enhanced oleic acid content in the soybean mutant M23 is associated with the deletion in the Fad2-1a gene encoding a fatty acid desaturase," JAOCS, 84(3):229-235, Mar. 2007.
Santiago et al., "Targeted gene knockout in mammalian cells by using engineered zinc-finger nucleases," Proc. Natl. Acad. Sci. USA, 105(15):5809-5814, Apr. 2008.
Scholze and Boch, "TAL effector-DNA specificity," Virulence, 1(5):428-432, Sep. 2010.
Scholze and Boch, "TAL effectors are remote controls for gene activation," Curr. Opin. Microbiol., 14(1):47-53, Feb. 2011.
Schornack et al., "Gene-for-gene-mediated recognition of nuclear-targeted AvrBs3-like bacterial effector proteins," J Plant Physiol 163: 256-272, 2006.
Schornack et al., "Characterization of AvrHah1, a novel AvrBs3-like effector from Xanthomonas gardneri with virulence and avirulence activity," New Phytol., 179(2):546-556, Jul. 2008.
Schornack et al., "Expression levels of avrBs3-like genes affect recognition specificity in tomato Bs4-but not in pepper Bs3-mediated perception," Mol. Plant-Microbe Interact, 18(11):1215-1225, Nov. 2005.
Schornack et al., "Gene-for-gene-mediated recognition of nuclear-targeted AvrBs3-like bacterial effector proteins," J. Plant Physiol., 163(3):256-272, Feb. 2006.
Schornack et al., "The tomato resistance protein Bs4 is a predicted non-nuclear TIR-NB-LRR protein that mediates defense responses to severely truncated derivatives of AvrBs4 and overexpressed AvrBs3," Plant J., 37(1):46-60, Jan. 2004.
Segal et al., "Endonuclease-induced, targeted homologous extrachromosomal recombination in Xenopus oocytes," Proc. Natl. Acad. Sci. USA, 92(3):806-810, Jan. 1995.
Sera, "Inhibition of virus DNA replication by artificial zinc finger proteins," J. Virol., 79(4):2614-2619, Feb. 2005.
Shepard and Totten, "Mesophyll cell protoplasts of potato: isolation, proliferation, and plant regeneration," Plant Physiol., 60(2):313-316, Aug. 1977.
Shukla et al., "Precise genome modification in the crop species Zea mays using zinc-finger nucleases," Nature, 459(7245):437-441, May 2009.
Simon et al., "Targeting DNA with triplex-forming oligonucleotides to modify gene sequence," Biochimie, 90(8):1109-1116, Aug. 2008.
Skipper, "The holy grail for plant biologists," Nature Reviews Genetics, 10(6):350, Jun. 2009.
Song et al., "Regeneration of plants from Alfalfa (Medicago sativa L.) protoplasts by direct embryogenesis," In: Plant Protoplasts and Genetic Engineering IV. Biotechnology in Agriculture and Forestry, vol. 23, pp. 60-70, 1993.
Stoddard et al., "Targeted mutagenesis in plant cells through transformation of sequence-specific nuclease mRNA," PloS one, 11(5), 2016.
Strasser et al., "Generation of glyco-engineered Nicotiana benthamiana for the production of monoclonal antibodies with a homogeneous human-like N-glycan structure," Plant Biotechnology Journal, 6(4):392-402, May 2008.
Studholme et al., "Genome-wide sequencing data reveals virulence factors implicated in banana Xanthomonas wilt," FEMS Microbiol. Lett., 310(2):182-192, Sep. 2010.
Sugio et al., "Two type III effector genes of Xanthomonas oryzae pv. oryzae control the induction of the host genes OsTFIIAγ1 and OsTFX1 during bacterial blight of rice," Proc Natl Acad Sci USA 104: 10720-10725, 2007.
Sugio et al., "Two type III effector genes of Xanthomonas oryzae pv. oryzae control the induction of the host, genes OsTFIIAgamma1 and OsTFX1 during bacterial blight of rice," Proc. Natl. Acad. Sci. USA, 104(25):10720-10725, Jun. 2007.
Swarup et al., "An Xanthomonas citri pathogenicity gene, pthA, pleiotropically encodes gratuitous avirulence on nonhosts," Mol. Plant Microbe Interact, 5(3):204-213, May 1992.
Szurek et al., "Eukaryotic features of the Xanthomonas type III effector AvrBs3: protein domains involved m transcriptional activation and the interaction with nuclear import receptors from pepper," Plant J., 26(5):523-534, Jun. 2001.
Szurek et al., "Type III-dependent translocation of the Xanthomonas AvrBs3 protein into the plant cell," Mol. Microbiol., 46(1):13-23, Oct. 2002.
Takenaka et al., "Inhibition of tomato yellow leaf curl virus replication by artificial zinc-finger proteins," Nucl. Acids Symposium Series, 51(1):429-430, Nov. 2007.
Thieme et al., "New type III effectors from Xanthomonas campestris pv. vesicatoria trigger plant reactions dependent on a conserved N-myristoylation motif," Mol. Plant Microbe Interact, 20(10):1250-1261, Oct. 2007.
Thierry et al., "Cleavage of yeast and bacteriophage T7 genomes at a single site using the rare cutter endonuclease I-Sce I," Nucl. Acids Res., 19(1):189-190, Jan. 1991.

(56) References Cited

OTHER PUBLICATIONS

Tohidfar et al., "Agrobacterium-mediated transformation of alfalfa (Medicago sativa) using a synthetic cry3a gene to enhance resistance against alfalfa weevil," Plant Cell, Tissue and Organ Culture, 113:227-235, 2013.

Tovkach et al., "A toolbox and procedural notes for characterizing novel zinc finger nucleases for genome editing in plant cells," Plant J., 57(4):747-757, Feb. 2009.

Townsend et al., "High-frequency modification of plant genes using engineered zinc-finger nucleases," Nature, 459(7245):442-445, May 2009.

Tzfira et al., "Genome modifications in plant cells by custom-made restriction enzymes," Plant Biotechnol J., 10(4):373-389, May 2012.

Urnov et al., "Highly efficient endogenous human gene correction using designed zinc-finger nuclease," Nature, 435(7042):646-651, Jun. 2005.

Van den Ackerveken et al., "Recognition of the bacterial avirulence protein AvrBs3 occurs inside the host plant cell," Cell, 87(7):1307-1316, Dec. 1996.

Van Den Elzen et al., "A chimaeric hygromycin resistance gene as a selectable marker in plant cells," Plant Molecular Biology, 5(5):299-302 Sep. 1985.

Vergunst et al., "VirB/D4-Dependent Protein Translocation from Agrobacterium into Plant Cells," Science, 290(5493):979-982, Nov. 2000.

Voytas and Joung, "Plant science. DNA binding made easy," Science, 326(5959):1491-1492, Dec. 2009.

Wah et al., "Structure of FokI has implications for DNA cleavage," Proc. Natl. Acad. Sci. USA, 95(18):10564-10569, Sep. 1998.

Wah et al., "Structure of the Multimodular Endonuclease FokI Bound to DNA," Nature, 388(3):97-100, Jul. 1997.

Wang et al., "Mutation of WRKY transcription factors initiates pith secondary wall formation and increases stem biomass in dicotyledonous plants," Proc Natl Acad Sci USA, 107: 22338-22343, 2010.

Wang et al., "Chemically regulated expression systems and their applications in transgenic plants," Transgenic Res., 12(5):529-540, Oct. 2003.

Weber et al., "The type III-dependent Hrp pilus is required for productive interaction of Xanthomonas campestris pv. vesicatoria with pepper host plants," J. Bacteriol., 187(7):2458-2468, Apr. 2005.

White and Yang, "Host and pathogen factors controlling the rice/Xanthomonas orvzae interaction," Plant Physiol., 150(4):1677-1686, Aug. 2009.

White et al., "The type III effectors of Xanthomonas," Mol. Plant. Pathol., 10(6):749-766, Nov. 2009.

Wright et al., "High-frequency homologous recombination in plants mediated by zinc-finger nucleases," Plant J., 44(4):693-705, Nov. 2005.

Yang and White, "Diverse members of the AvrBs3/PthA family of type III effectors are major virulence determinants in bacterial blight disease of rice," Mol. Plant Microbe Interact, 17(11):1192-1200, Nov. 2004.

Yang et al., "Os8N3 is a host disease-susceptibility gene for bacterial blight of rice," Proc Natl Acad Sci USA 103: 10503-10508, 2006.

Yang et al., "Avoidance of host recognition by alterations in the repetitive and C-terminal regions of AvrXa7, a type III effector of Xanthomonas oryzae pv. oryzae," Mol. Plant Microbe Interact, 18(2):142-149, Feb. 2005.

Yang et al., "Os8N3 is a host disease-susceptibility gene for bacterial blight of rice," Proc. Natl. Acad. Sci. USA, 103(27):10503-10508, Jul. 2006.

Yang et al., "The virulence factor AvrXa7 of Xanthomonas oryzae pv. oryzae is a type III secretion pathway-dependent nuclear-localized double-stranded DNA-binding protein," Proc. Natl. Acad. Sci. USA, 97(17): 9807-9812, Aug. 2000.

Yoo et al., "*Arabidopsis mesophyll* protoplasts: a versatile cell system for transient gene expression analysis," Nature Protocols, 2(7):1565-1572, Jul. 2007.

Yuan et al., "Characterization of Xanthomonas oryzae-responsive cis-acting element in the promoter of rice race-specific susceptibility gene Xa13," Mol. Plant, 4(2):300-309, Mar. 2011.

Zhang et al., "Efficient construction of sequence-specific TAL effectors for modulating mammalian transcription.,'"Nat. Biotechnol., 29(2):149-153, Feb. 2011.

Zhang et al., "High frequency targeted mutagenesis in *Arabidopsis thaliana* using zinc finger nucleases," Proc. Natl. Acad. Sci. USA, 107(26):12028-12033, Jun. 2010.

Zhang et al., "RNAi effects on regulation of endogenous acid invertase activity in potato (*Solanum tuberosum* L. ) tubers," Chin. J. Agric. Biotechnol., 5(2):107-112, Aug. 2008.

Zhu et al., "The C terminus of AvrXa10 can be replaced by the transcriptional activation domain of VP16 from the herpes simplex virus," Plant Cell, 11(9):1665-1674, Sep. 1999.

Zhu et al., "AvrXa10 Contains an Acidic Transcriptional Activation Domain in the Functionally Conserved C Terminus," Molecular Plant-Microbe Interactions, 11(8): 824-832, Aug. 1998.

Zhu et al., "The rsma-like gene rsmA(XOO) of Xanthomonas oryzae pv. oiyzae regulates bacterial virulence and production of diffusible signal factor," Mol. Plant Pathol., 12(3):227-237, Apr. 2011.

Zou et al., "Identification of an avirulence gene, avrxa5, from the rice pathogen Xanthomonas oryzae pv. oryzae," Sci. China Life Sci., 53(12):1440-1449, Dec. 2010.

Zrenner et al., "Soluble acid invertase determines the hexose-to sucrose ratio in cold-stored potato tubers," Planta, 198(2):246-252, Feb. 1996.

Zubieta et al., "Structural basis for the modulation of lignin monomer methylation by caffeic acid/5-hydroxyferulic acid 3/5-O-methyltransferase," Plant Cell, 14: 1265-1277, 2002.

Zuo and Chua, "Chemical-inducible systems for regulated expression of plant genes," Curr. Opin. Biotechnol., 11(2):146-151, Apr. 2000.

Zuo et al., "Technical advance: An estrogen receptor-based transactivator XVE mediates highly inducible gene expression in transgenic plants," Plant J., 24(2):265-273, Oct. 2000.

\* cited by examiner

FIG. 1

*Medicago sativa*, COMT coding sequence; GenBank accession number GU066087.1

ATGGGTTCAACAGGTGAAACTCAAATAACACCAACCCACATATCAGATGAAGAAGCAAACCT
CTTCGCCATGCAACTAGCAAGTGCTTCAGTTCTTCCCATGATTTGAAATCAGCTCTTGAAC
TTGATCTCTTAGAAAATCATTGCTAAAGCTGGACCTGGTGCTCAAATTCACCTATTGAAATT
GCTTCTCAGCTTCCAACAACTAACCCTGATGCACCAGTCATGTTGGACCGAATGTTGCGTCT
CTTGGCTTGTTACAATATCCTCACTTGTTCTGTTCTTCGTACTCAACAAGATGGAAAGTTCAGA
GACTTTACGGTTTGGCTACTGTTGCTAAGTATTGGTTAAGAATGAAGATGGTGTTTCTATT
TCTGCTCTTAATCTCATGAATCAGGATAAAGTGCTCATGGAAAGCTGGTACCACCTAAAGA
TGCAGTCCTTGATGGGGCATTCAACAAGGTTTAACAAGGCTTATGGAATGACAGCCTTTGAATACC
ATGGAACAGATCCAAGGTTTAACAAGGTTTCAACAAGGGATGTCTGATCACTCTACCATC
ACAATGAAGAAAATTCTTGAGACCTACACAGGTTTTGAAGGCCTTAAATCTCTTGTTGATGT
AGTGGTGGTACCGGAGCTGTAATTAACACGATTGTCTCAAAATATCCCACTATTAAGGGTA
TTAATTTTGATTTACCCCATGTCAGTAGTCCAAAGGCTGATGCTGTTTTTATGAAGTGGATTTGTCA
GGTGGAGACATGTTTGTCAGTATTCCAAAGGCTGATGCTGTTTTTATGAAGTGGATTTGTCA
TGACTGGAGTGATGAGCACTGTTGGCAGAACTGCTATGAGGCACTGCCAGACA
ATGGAAAAGTGTGGTTCACATTGATGTGATCATATCTTCCAGTGGCTCATAATCCAGGTGGCCACA
AAAGGTGTGGTTCACATTGATGTGATCATGTTGCCAAAGGTGCTGGATTCCAAGGTTTCAAAGTCCATTGTA
ACAAAAAGAGTTTGAGGATCTTGCCAAAGGTGCTGGATTCCAAGGTTTCAAAGTCCATTGTA
ATGCTTTCAACACATACATCATGGAGTTTCTTAAGAAGGTTTAA (SEQ ID NO:1)

FIG. 2

*Medicago sativa*, partial COMT sequence, from variety SW 8421-S, Allele #1

ATGGGTTCAACAGGTGAAACTCAAATAACACCAACCCACATATCAGATGAAGAAGCA
AACCTCTTCGCCATGCAATTAGCAAGTGCTTCAGTTCTTCCCATGATTTTAAAATCA
GCTCTTGAACTTGATCTCTTAGAAATCATTGCTAAAGCTGGACCTGGTGCTCAAATT
TCACCTATTGAAATTGCTTCTCAGCTCCCAACAACTAACCCTGATGCACCAGTTATG
TTGGACCGAATGTTGCGTCTCTTGGCTTGTTACAATATCCTCACTTGTTCAGTTCGT
ACTCAACAAGATGGAAAGGTTCAGAGACTTTATGGTTTGG (SEQ ID NO:9)

FIG. 3

*Medicago sativa*, partial COMT sequence, from variety SW 8421-S, Allele #2

ATGGGTTCAACAGGTGAAACTCAAATAACACCAACCCACATATCAGATGAAGAAGCA
AACCTCTTCGCCATGCAACTAGCAAGTGCTTCAGTTCTTCCCATGATTTTGAAATCA
GCTCTTGAACTTGATCTCTTAGAAATCATTGCTAAAGCTGGACCTGGTGCTCAAATT
TCACCTATTGAAATTGCTTCTCAGCTACCAACAACTAACCCTGATGCACCAGTTATG
TTGGACCGAATGTTGCGTCTCTTGGCTTGTTACAATATCCTCACTTGTTCAGTTCGT
ACTCAACAAGATGGAAAGGTTCAGAGACTTTATGGTTTGGCT (SEQ ID NO:10)

FIG. 4

*Medicago sativa*, partial COMT sequence, from variety SW 8421-S, Allele #3

ATGGGTTCAACAGGTGAAACTCAAATAACACCAACCCACATATCAGATGAAGAAGCAA
ACCTCTTCGCCATGCAACTAGCAAGTGCTTCAGTTCTTCCCATGATTTTGAAATCAGC
TCTTGAACTTGATCTCTTAGAAATCATTGCTAAAGCTGGACCTGGTGCTCAAATTTCA
CCTATTGAAATTGCTTCTCAGCTACCAACAACTAACCCTGATGCACCAGTTATGTTGG
ACCGAATGTTGCGTCTCTTGGCTTGTTACAATATCCTCACTTGTTCAGTTCGTACTCA
ACAAGATGGAAAAGTTCAGAGACTTTATGGTTTGGCTACTGT (SEQ ID NO:11)

FIG. 5

*Medicago sativa*, partial COMT sequence, from variety SW 8421-S, Allele #4

ATGGGTTCAACAGGTGAAACTCAAATAACACCAACCCACATATCAGATGAAGAAGCA
AACCTCTTCGCCATGCAATTAGCAAGTGCTTCAGTTCTTCCCATGATTTTAAAATCA
GCTCTTGAACTTGATCTCTTAGAAATCATTGCTAAAGCTGGACCTGGTGCTCAAATT
TCACCTATTGAAATTGCTTCTCAGCTCCCAACAACTAACCCTGATGCACCAGTTATG
TTGGACCGAATGTTGCGTCTCTTGGCTTGTTACAATATCCTCACTTGTTCAGTTCGT
ACTCAACAAGATGGAAAGATTCAGAGACTTTATGGTTTGG (SEQ ID NO:12)

FIG. 6

*Medicago sativa*, partial COMT sequence, from variety SW 8421-S, Allele #5

ATGGGTTCAACAGGTGAAACTCAAATAACACCAACCCACATATCAGATGAAGAAGCA
AACCTCTTCGCCATGCAACTAGCAAGTGCTTCAGTTCTTCCCATGATTTTGAAATCA
GCTCTTGAACTTGATCTCTTAGAAATCATTGCTAAAGCTGGACCTGGTGCCCAAATT
TCACCTATTGAAATTGCTTCTCAGCTACCAACAACTAACCCTGATGCACCAGTTATG
TTGGACCGAATGTTGCGTCTCTTGGCTGTTACAATATCCTCACTTGTTCAGTTCGT
ACTCAACAAGATGGAAAGGTTCAGAGACTTTATGGTTTGGCT (SEQ ID NO:13)

FIG. 7

*Medicago sativa*, partial COMT sequence, from variety SW 8421-S, Allele #6

ATGGGTTCAACAGGTGAAACTCAAATAACACCAACCCACATATCAGATGAAGAAGCA
AACCTCTTCGCCATGCAACTAGCAAGTGCTTCAGTTCTTCCCATGATTTTGAAATCA
GCTCTTGAACTTGATCTATTAGAAATCATTGCTAAAGCTGGACCTGGTGCTCAAATT
TCACCTATTGAAATTGCTTCTCAGCTACCAACAACTAACCCTGATGCACCAGTTATG
TTGGACCGAATGTTGCGTCTCTTGGCTTGTTACAATATCCTCACTTGTTCAGTTCGT
ACTCAACAAGATGGAAAGGTTCAGAGAGACTTTATGGTTTGG (SEQ ID NO:14)

FIG. 8

*Medicago sativa*, partial COMT sequence, from variety SW 8421-S, Allele #7

ATGGGTTCAACAGGTGAAACTCAAATAACACCAACCCACATATCAGATGAAGAAGCA
AACCTCTTCGCCATGCAATTAGCAAGTGCTTCAGTTCTTCCCATGATTTTAAAATCA
GCTCTTGAACTTGATCTCTTAGAAATCATTGCTAAAGCTGGACCTGGTGCTCAAATT
TCACCTGTTCAAATTGCTTCTCAGCTTCCAACAACTAACCCTGATGCACCAGTCATG
TTGGACCGAATGTTGCGTCTCTTGGCTTGTTACAATATCCTCACTTGTTCTGTTCGT
ACTCAACAAGATGGAAAGGTTCAGAGACTTTATGGTTT (SEQ ID NO:15)

FIG. 9

Ms491-1 (three allele mutant)

```
SEQ ID NO:6      TTCAACAGGTGAAACTCAAATAACACCAACCCACATATCAGATGAAGAA    TALEN binding site SEQ ID NO:6      TTCAACAGGTGAAACTCAAATAACACCAACCCACATATCAGATGAAGAA    WT
SEQ ID NO:32526  TTCAACAGGTGAAACTCAA-----ACCAACCCACATATCAGATGAAGAA    -5 bp
SEQ ID NO:32527  TTCAACAGGTGAAACT----------CAACCCACATATCAGATGAAGAA    -10 bp
SEQ ID NO:32528  TTCAACAGGTGAAACT-------------CCCACATATCAGATGAAGAA    -13 bp
```

FIG. 10

Ms492-2 (four allele mutant)

```
SEQ ID NO:7        TGAACTTGGATCTCTTAGAAATCATTGCTAAAGCTGGACCTGGTGCTCAA    TALEN binding site SEQ ID NO:32529    TGAACTTGATCTCTTAG-----------AAAGCTGGACCTGGTGCTCAA    -11 bp
SEQ ID NO:32530    TGAACTTGAT----------------CTAAAGCTGGACCTGGTGCTCAA    -16 bp
SEQ ID NO:32531    TGAACTTGATCTCTTAGAAA------CTAAAGCTGGACCTGGTGCTCAA    -6 bp
SEQ ID NO:32532    TGAACTTGATCTCTTA----------CTAAAGCTGGACCTGGTGCTCAA    -10 bp
```

FIG. 11

Ms589-1 (four allele mutant)

```
                                        TTGCTTCTCAGCTACCAACAACTAACCCTGATGCACCAGTTATGTTGA        TALEN binding site
SEQ ID NO:8

SEQ ID NO:32533   TCACCTATTGAAATTGCTTCTCAGCTA-----------CCTGATGCACCAGTTATGTTGGACCGAATGTTGCGTCT    -12 bp
SEQ ID NO:32534   TCACCTATTGAA-------------------------GATGCACCAGTTATGTTGGACCGAATGTTGCGTCT        -30 bp
SEQ ID NO:32535   TCACCTATTGAAATTGCTTCTCAGCT-------------------CACCAGTTATGTTGGACCGAATGTTGCGTCT    -20 bp
SEQ ID NO:32536   TCACCTATTG------------------------------------------------TGTTGCGTCT           -57 bp
```

FIG. 12

Ms553-1 (one allele mutant)

```
SEQ ID NO:7          TGAACTTGATCTCTTAGAAATCATTGCTAAAGCTGGACCTGGTGCTCAA    TALEN binding site SEQ ID NO:7          TGAACTTGATCTCTTAGAAATCATTGCTAAAGCTGGACCTGGTGCTCAA    WT
SEQ ID NO:32537      TGAACTTGATCTCTTAGA----------AAAGCTGGACCTGGTGCTCAA    -10
SEQ ID NO:7          TGAACTTGATCTCTTAGAAATCATTGCTAAAGCTGGACCTGGTGCTCAA    WT
SEQ ID NO:7          TGAACTTGATCTCTTAGAAATCATTGCTAAAGCTGGACCTGGTGCTCAA    WT
```

ALFALFA WITH REDUCED LIGNIN COMPOSITION

CROSS-REFERENCE TO RELATED APPLICATIONS

This application is a U.S. National Stage Application under 35 U.S.C. § 371 of International Application Serial No. PCT/IB2018/052878, filed on Apr. 25, 2018, which claims benefit of priority from U.S. Provisional Application Ser. No. 62/489,647, filed on Apr. 25, 2017, the contents of which are incorporated herein by reference in their entirety.

TECHNICAL FIELD

This document relates to materials and methods for altering the lignin content and composition in alfalfa and other members of the *Medicago* genus. For example, this document relates to materials and methods for inactivating or attenuating lignin-associated genes in *Medicago sativa*, resulting in alfalfa plants that can have reduced syringyl (S) unit content. In some cases, the alfalfa plants also can have reduced lignin content.

BACKGROUND

Alfalfa, *Medicago sativa*, is an important forage crop in many countries, and is an excellent source of protein, vitamins, minerals and digestible fiber. One quality trait in alfalfa is lignin content. Lignin is a component in cell walls that is critical for plant growth, water conductivity, plant development and structure, and pathogen resistance. Lignin is comprised of three monomers—p-coumaryl alcohol, coniferyl alcohol, and sinapyl alcohol, with each monomer having a carbon ring with a different methyoxy group configuration and 3-carbon tail. To form lignin, the monomers polymerize in the form of phenylpropanoids p-hydroxyphenyl (H lignin), guaiacyl (G lignin) and syringyl (S lignin) units. Dicotyledonous plants, including alfalfa, are mainly comprised of mixtures of G and S lignin, whereas monocotyledonous plants are mainly comprised of mixtures of G, S, and H lignin.

High lignin content in alfalfa is associated with decreased forage quality and decreased digestibility. As alfalfa plant maturity increases, the amount of fiber, including lignin, increases, and the digestibility decreases. The content of lignin, hemicellulose and cellulose within alfalfa plants can be measured as neutral detergent fiber digestibility (NDFD). NDFD is an indication to the amount of energy animals can extract from alfalfa. Because lignin is mainly indigestible and reduces the digestion of other fiber in animals, the predicted energy content of alfalfa decreases with decreasing NDFD. A reduced lignin alfalfa variety may have a higher NDFD level, resulting in greater digestibility and improved feeding value when compared to conventional varieties. Reduced lignin alfalfa also may provide growers with the ability to delay harvest to a later stage of maturity, without a loss in digestibility.

SUMMARY

This document is based, at least in part, on the discovery that genome editing can be used to generate modified alfalfa plants having enhanced feed value components, such as reduced lignin content, reduced syringyl (S) unit content, and/or increased NDFD. As described herein, alfalfa plants with enhanced feed value components can be generated using sequence-specific nucleases to inactivate or attenuate the caffeic acid O-methyltransferase (COMT) gene. Thus, this document provides materials and methods for using genome editing to generate mutations within alleles of the COMT gene in plants, plant parts, and plant cells of alfalfa and other members of the *Medicago* genus. Plants, plant parts, and plant cells (e.g., compositions that are plants, plant parts, or plant cells) containing COMT mutations generated according to the described methods also are provided herein.

In a first aspect, this document features a composition, wherein the composition is an alfalfa plant, a plant part of the alfalfa plant, or a plant cell of the alfalfa plant, wherein the genome of the alfalfa plant, the plant part, and the plant cell comprises an induced mutation in each COMT allele of the genome, and wherein the alfalfa plant comprises a reduction in syringyl (S) units as compared to a corresponding wild type alfalfa plant. The composition can be the alfalfa plant, the plant part (e.g., a plant part selected from the group consisting of a stem, a leaf, a flower, and a seed), or the plant cell. Each induced mutation can include a deletion of one or more nucleic acid base pairs. At least one induced mutation can be an in-frame deletion of two or more (e.g., two to ten) consecutive nucleic acid codons. Each induced mutation can be within a nucleic acid sequence as set forth in any of SEQ ID NOS:9-15, or within a sequence having at least 90% identity to any of SEQ ID NOS:9-15. The induced mutation can include a deletion selected from the group consisting of a deletion of the cytosine at position 29 of any of SEQ ID NOS:9-15 or at the corresponding position within a sequence having at least 90% identity to any of SEQ ID NOS:9-15, a deletion of the thymine at position 144 of any of SEQ ID NOS:9-15 or at the corresponding position within a sequence having at least 90% identity to any of SEQ ID NOS:9-15, and a deletion of the adenine at position 208 of any of SEQ ID NOS:9-15 or at the corresponding position within a sequence having at least 90% identity to any of SEQ ID NOS:9-15. Each induced mutation can yield a COMT allele containing a sequence selected from the group consisting of SEQ ID NOS:32526 to 32537. Each induced mutation can be within a nucleic acid sequence as set forth in any of SEQ ID NOS:6-8, or within a sequence having at least 90% identity to any of SEQ ID NOS:6-8. The plant can produce a polypeptide containing the amino acid sequence set forth in SEQ ID NO:32538 or SEQ ID NO:32539. Each induced mutation can be induced by a rare-cutting endonuclease. The rare-cutting endonuclease can be a transcription activated-like effector (TALE) nuclease. The TALE nuclease can bind to a nucleic acid sequence as set forth in any of SEQ ID NOS:6-8. The alfalfa plant can exhibit a reduction in S units as determined using Maule staining. The alfalfa plant further can have reduced lignin content as compared to a corresponding wild type alfalfa plant.

In another aspect, this document features a composition, wherein the composition is an alfalfa plant, a plant part of the alfalfa plant, or a plant cell of the alfalfa plant, wherein the genome of the alfalfa plant, the plant part, and the plant cell comprises four COMT alleles, wherein one, two, or three of the four COMT alleles comprise an induced mutation with each remaining COMT allele of the four COMT alleles being a wild type COMT allele, and wherein an offspring alfalfa plant of the alfalfa plant that comprises at least one of the COMT alleles comprising the induced mutation with each remaining COMT allele of the offspring alfalfa plant comprising a null mutation comprises a reduction in S units as compared to a corresponding wild type alfalfa plant. The composition can be the alfalfa plant, the plant part (e.g., a plant part selected from the group consisting of a stem, a leaf, a flower, and a seed), or the plant cell. Each induced mutation can include a deletion of one or more nucleic acid base pairs. At least one induced mutation can be an in-frame deletion of two or more (e.g., two to ten) consecutive nucleic acid codons. Each induced mutation can be within a nucleic acid sequence as set forth in any of SEQ ID NOS:9-15, or within a sequence having at least 90% identity to any of SEQ ID NOS:9-15. The induced mutation can include a deletion selected from the group consisting of a deletion of the cytosine at position 29 of any of SEQ ID NOS:9-15 or at the corresponding position within a sequence having at least 90% identity to any of SEQ ID NOS:9-15, a deletion of the thymine at position 144 of any of SEQ ID NOS:9-15 or at the corresponding position within a sequence having at least 90% identity to any of SEQ ID NOS:9-15, and a deletion of the adenine at position 208 of any of SEQ ID NOS:9-15 or at the corresponding position within a sequence having at least 90% identity to any of SEQ ID NOS:9-15. Each induced mutation can yield a COMT allele containing a sequence selected from the group consisting of SEQ ID NOS:32526 to 32537. Each induced mutation can be within a nucleic acid sequence as set forth in any of SEQ ID NOS:6-8, or within a sequence having at least 90% identity to any of SEQ ID NOS:6-8. The plant can produce a polypeptide containing the amino acid sequence set forth in SEQ ID NO:32538 or SEQ ID NO:32539. Each induced mutation can be induced by a rare-cutting endonuclease. The rare-cutting endonuclease can be a TALE nuclease. The TALE nuclease can bind to a nucleic acid sequence as set forth in any of SEQ ID NOS:6-8. The alfalfa plant can exhibit a reduction in S units as determined using Maule staining. The alfalfa plant further can have reduced lignin content as compared to a corresponding wild type alfalfa plant. The alfalfa plant can contain one COMT allele having the induced mutation and three wild type COMT alleles, two COMT alleles having the induced mutation and two wild type COMT alleles, or three COMT alleles having the induced mutation and one wild type COMT allele.

In another aspect, this document features a container containing alfalfa seeds, wherein at least one of the alfalfa seeds has an induced mutation in each COMT allele. An alfalfa plant grown from the at least one seed can have a reduction in syringyl (S) units as compared to a corresponding wild type alfalfa plant. The alfalfa plant grown from the at least one seed can exhibit a reduction in S units as determined using Maule staining. The alfalfa plant grown from the at least one seed can further have reduced lignin content as compared to a corresponding wild type alfalfa plant. Each induced mutation can include a deletion of one or more nucleic acid base pairs. At least one induced mutation can be an in-frame deletion of two or more (e.g., two to ten) consecutive nucleic acid codons. Each induced mutation can be within a nucleic acid sequence as set forth in any of SEQ ID NOS:9-15, or within a sequence having at least 90% identity to any of SEQ ID NOS:9-15. The induced mutation can include a deletion selected from the group consisting of a deletion of the cytosine at position 29 of any of SEQ ID NOS:9-15 or at the corresponding position within a sequence having at least 90% identity to any of SEQ ID NOS:9-15, a deletion of the thymine at position 144 of any of SEQ ID NOS:9-15 or at the corresponding position within a sequence having at least 90% identity to any of SEQ ID NOS:9-15, and a deletion of the adenine at position 208 of any of SEQ ID NOS:9-15 or at the corresponding position within a sequence having at least 90% identity to any of SEQ ID NOS:9-15. Each induced mutation can yield a COMT allele containing a sequence selected from the group consisting of SEQ ID NOS:32526 to 32537. Each induced mutation can be within a nucleic acid sequence as set forth in any of SEQ ID NOS:6-8, or within a sequence having at least 90% identity to any of SEQ ID NOS:6-8. The plant can produce a polypeptide containing the amino acid sequence set forth in SEQ ID NO:32538 or SEQ ID NO:32539. Each induced mutation can be induced by a rare-cutting endonuclease. The rare-cutting endonuclease can be a transcription activated-like effector (TALE) nuclease. The TALE nuclease can bind to a nucleic acid sequence as set forth in any of SEQ ID NOS:6-8. The container can be a bag. At least 25 percent (e.g., at least 50 percent or at least 75 percent) of the seeds within the container can have an induced mutation in each COMT allele.

In another aspect, this document features a method for producing an alfalfa plant, wherein the method includes providing a population of alfalfa cells that each have four COMT alleles, contacting the population of alfalfa cells with one or more rare-cutting endonucleases targeted to one or more of the four COMT alleles, regenerating alfalfa plants from the population of alfalfa cells, and selecting an alfalfa plant with a mutation in one or more of the four COMT alleles. The selected alfalfa plant can have a mutation in each of the four COMT alleles, a mutation in three of the four COMT alleles, a mutation in two of the four COMT alleles, or a mutation in one of the four COMT alleles. The selected alfalfa plant can have a reduction in S units as compared to a corresponding wild type alfalfa plant. The selected alfalfa plant exhibits a reduction in S units as determined using Maule staining. The selected alfalfa plant can exhibit reduced lignin content as compared to a corresponding wild type alfalfa plant. Each induced mutation can include a deletion of one or more nucleic acid base pairs. At least one induced mutation can be an in-frame deletion of two or more (e.g., two to ten) consecutive nucleic acid codons. Each induced mutation can be within a nucleic acid sequence as set forth in any of SEQ ID NOS:9-15, or within a sequence having at least 90% identity to any of SEQ ID NOS:9-15. The induced mutation can include a deletion selected from the group consisting of a deletion of the cytosine at position 29 of any of SEQ ID NOS:9-15 or at the corresponding position within a sequence having at least 90% identity to any of SEQ ID NOS:9-15, a deletion of the thymine at position 144 of any of SEQ ID NOS:9-15 or at the corresponding position within a sequence having at least 90% identity to any of SEQ ID NOS:9-15, and a deletion of the adenine at position 208 of any of SEQ ID NOS:9-15 or at the corresponding position within a sequence having at least 90% identity to any of SEQ ID NOS:9-15. Each induced mutation can yield a COMT allele containing a sequence selected from the group consisting of SEQ ID NOS:32526 to 32537. Each induced mutation can be within a nucleic acid sequence as set forth in any of SEQ ID NOS:6-8, or within a sequence having at least 90% identity to any of SEQ ID NOS:6-8. The plant can produce a polypeptide containing the amino acid sequence set forth in SEQ ID NO:32538 or SEQ ID NO:32539. Each induced mutation can be induced by a rare-cutting endonuclease. The rare-cutting endonuclease can be a TALE nuclease. The TALE nuclease can bind to a nucleic acid sequence as set forth in any of SEQ ID NOS:6-8.

This document also features an isolated nucleic acid molecule containing the nucleotide sequence of any of SEQ ID NOS:32526 to 32537.

In addition, this document features an isolated nucleic acid molecule containing a nucleic acid sequence encoding an alfalfa COMT polypeptide, provided that the nucleic acid sequence has an in-frame deletion of at least three or six nucleotides as compared to a corresponding nucleic acid sequence encoding a wild type alfalfa COMT polypeptide.

In yet another aspect, this document features a composition, wherein the composition is an alfalfa plant, a plant part of the alfalfa plant, or a plant cell of the alfalfa plant, wherein the genome of the alfalfa plant, the plant part, and the plant cell comprises an induced mutation in each COMT allele of the genome, and wherein the alfalfa plant comprises decreased lignin content as compared to a corresponding wild type alfalfa plant. The composition can be the alfalfa plant, the plant part (e.g., a plant part selected from the group consisting of a stem, a leaf, a flower, and a seed), or the plant cell. Each induced mutation can include a deletion of one or more nucleic acid base pairs. At least one induced mutation can be an in-frame deletion of two or more (e.g., two to ten) consecutive nucleic acid codons. Each induced mutation can be within a nucleic acid sequence as set forth in any of SEQ ID NOS:9-15, or within a sequence having at least 90% identity to any of SEQ ID NOS:9-15. The induced mutation can include a deletion selected from the group consisting of a deletion of the cytosine at position 29 of any of SEQ ID NOS:9-15 or at the corresponding position within a sequence having at least 90% identity to any of SEQ ID NOS:9-15, a deletion of the thymine at position 144 of any of SEQ ID NOS:9-15 or at the corresponding position within a sequence having at least 90% identity to any of SEQ ID NOS:9-15, and a deletion of the adenine at position 208 of any of SEQ ID NOS:9-15 or at the corresponding position within a sequence having at least 90% identity to any of SEQ ID NOS:9-15. Each induced mutation can yield a COMT allele containing a sequence selected from the group consisting of SEQ ID NOS:32526 to 32537. Each induced mutation can be within a nucleic acid sequence as set forth in any of SEQ ID NOS:6-8, or within a sequence having at least 90% identity to any of SEQ ID NOS:6-8. The plant can produce a polypeptide containing the amino acid sequence set forth in SEQ ID NO:32538 or SEQ ID NO:32539. Each induced mutation can be induced by a rare-cutting endonuclease. The rare-cutting endonuclease can be a TALE nuclease. The TALE nuclease can bind to a nucleic acid sequence as set forth in any of SEQ ID NOS:6-8.

In another aspect, this document features a composition, wherein the composition is an alfalfa plant, a plant part of the alfalfa plant, or a plant cell of the alfalfa plant, wherein the genome of the alfalfa plant, the plant part, and the plant cell has four COMT alleles, wherein one, two, or three of the four COMT alleles contain an induced mutation with each remaining COMT allele of the four COMT alleles being a wild type COMT allele, and wherein an offspring alfalfa plant of the alfalfa plant that has at least one of the COMT alleles containing the induced mutation with each remaining COMT allele of the offspring alfalfa plant containing a null mutation has reduced lignin content as compared to a corresponding wild type alfalfa plant. The composition can be the alfalfa plant, the plant part (e.g., a plant part selected from the group consisting of a stem, a leaf, a flower, and a seed), or the plant cell. Each induced mutation can include a deletion of one or more nucleic acid base pairs. At least one induced mutation can be an in-frame deletion of two or more (e.g., two to ten) consecutive nucleic acid codons. Each induced mutation can be within a nucleic acid sequence as set forth in any of SEQ ID NOS:9-15, or within a sequence having at least 90% identity to any of SEQ ID NOS:9-15. The induced mutation can include a deletion selected from the group consisting of a deletion of the cytosine at position 29 of any of SEQ ID NOS:9-15 or at the corresponding position within a sequence having at least 90% identity to any of SEQ ID NOS:9-15, a deletion of the thymine at position 144 of any of SEQ ID NOS:9-15 or at the corresponding position within a sequence having at least 90% identity to any of SEQ ID NOS:9-15, and a deletion of the adenine at position 208 of any of SEQ ID NOS:9-15 or at the corresponding position within a sequence having at least 90% identity to any of SEQ ID NOS:9-15. Each induced mutation can yield a COMT allele containing a sequence selected from the group consisting of SEQ ID NOS:32526 to 32537. Each induced mutation can be within a nucleic acid sequence as set forth in any of SEQ ID NOS:6-8, or within a sequence having at least 90% identity to any of SEQ ID NOS:6-8. The plant can produce a polypeptide containing the amino acid sequence set forth in SEQ ID NO:32538 or SEQ ID NO:32539. Each induced mutation can be induced by a rare-cutting endonuclease. The rare-cutting endonuclease can be a TALE nuclease. The TALE nuclease can bind to a nucleic acid sequence as set forth in any of SEQ ID NOS:6-8. The alfalfa plant can exhibit a reduction in S units as determined using Maule staining. The alfalfa plant further can have reduced lignin content as compared to a corresponding wild type alfalfa plant. The alfalfa plant can contain one COMT allele having the induced mutation and three wild type COMT alleles, two COMT alleles having the induced mutation and two wild type COMT alleles, or three COMT alleles having the induced mutation and one wild type COMT allele.

In still another aspect, this document features a composition, wherein the composition is an alfalfa plant, a plant part of the alfalfa plant, or a plant cell of the alfalfa plant, wherein the genome of the alfalfa plant, the plant part, and the plant cell contains an induced mutation in each COMT allele of the genome.

The composition can be the alfalfa plant, the plant part (e.g., a plant part selected from the group consisting of a stem, a leaf, a flower, and a seed), or the plant cell. Each induced mutation can include a deletion of one or more nucleic acid base pairs. At least one induced mutation can be an in-frame deletion of two or more (e.g., two to ten) consecutive nucleic acid codons. Each induced mutation can be within a nucleic acid sequence as set forth in any of SEQ ID NOS:9-15, or within a sequence having at least 90% identity to any of SEQ ID NOS:9-15. The induced mutation can include a deletion selected from the group consisting of a deletion of the cytosine at position 29 of any of SEQ ID NOS:9-15 or at the corresponding position within a sequence having at least 90% identity to any of SEQ ID NOS:9-15, a deletion of the thymine at position 144 of any of SEQ ID NOS:9-15 or at the corresponding position within a sequence having at least 90% identity to any of SEQ ID NOS:9-15, and a deletion of the adenine at position 208 of any of SEQ ID NOS:9-15 or at the corresponding position within a sequence having at least 90% identity to any of SEQ ID NOS:9-15. Each induced mutation can yield a COMT allele containing a sequence selected from the group consisting of SEQ ID NOS:32526 to 32537. Each induced mutation can be within a nucleic acid sequence as set forth in any of SEQ ID NOS:6-8, or within a sequence having at least 90% identity to any of SEQ ID NOS:6-8. The plant can produce a polypeptide containing the amino acid sequence set forth in SEQ ID NO:32538 or SEQ ID NO:32539. Each induced mutation can be induced by a rare-cutting endonuclease. The rare-cutting endonuclease can be a TALE nuclease. The TALE nuclease can bind to a nucleic acid sequence as set forth in any of SEQ ID NOS:6-8.

In another aspect, this document provides an alfalfa plant, a plant part of the alfalfa plant, or a plant cell of the alfalfa plant, where the alfalfa plant, plant part, or plant cell has an induced mutation in one or more COMT alleles. The alfalfa plant can have decreased lignin content as compared to a corresponding wild type alfalfa plant. The alfalfa plant can have a reduction in syringyl (S) units as compared to a corresponding wild type alfalfa plant. The alfalfa plant, plant part, or plant cell can have an induced mutation in one, two, three, or four COMT alleles. The alfalfa plant, plant part, or plant cell can have an induced mutation within a sequence as set forth in any of SEQ ID NOS:9-15, or in the coding sequence within SEQ NO:32524, or within a sequence with at least 90% identity to any of SEQ ID NOS:1 and 9-15, or to the coding sequence within SEQ ID NO:32524. The alfalfa plant, plant part, or plant cell can have a deletion of the cytosine at position 29 of any of SEQ ID NOS:9-15 and 32524, a deletion of the thymine at position 144 of any of SEQ ID NOS:9-45, or a deletion of the adenine at position 208 of any of SEQ ID NOS:9-15. The alfalfa plant, plant part, or plant cell can be made using a rare-cutting endonuclease. The alfalfa plant, plant part, or plant cell may or may not contain a transgene. When present, the transgene can encode a protein selected from the group consisting of a plant 5-enolpyruvylshikimate-3-phosphate synthase (EPSPS) protein, a modified plant EPSPS protein, a bacterial EPSPS protein, an *agrobacterium* CP4 EPSPS protein, an aryloxyalkanoate dioxygenase (AAD) protein, a phosphinothricin N-acetyltransferase (PAT) protein, an acetohydroxyacid synthase large subunit protein, a p-hydroxyphenylpyruvate dioxygenase (hppd) protein, and a dicamba monooxygenase (DMO) protein.

In another aspect, this document provides a method for producing an alfalfa plant having an induced mutation in one or more COMT alleles. The method can include providing a population of alfalfa cells containing one or more functional COMT alleles, contacting the population of alfalfa cells with one or more rare-cutting endonucleases targeted to the one or more COMT alleles, regenerating alfalfa plants from the population of alfalfa cells, and selecting an alfalfa plant with a rare-cutting endonuclease-induced mutation in the one or more COMT alleles. The selected alfalfa plant can have decreased lignin content, a reduction in S units, or decreased lignin content and a reduction in S units as compared to a corresponding wild type alfalfa plant. The method can include using a transcription activator-like effector (TALE) nuclease targeted to a sequence within any of the sequences set forth in SEQ ID NOS:9-15, or using a TALE nuclease targeted to a sequence within any of the sequences set forth in SEQ ID NOS:6-8. The selected alfalfa plant can have a rare-cutting endonuclease-induced mutation in one, two, three, or four COMT alleles.

In another aspect, this document provides a method for generating an alfalfa plant or plant part with decreased lignin content. The method can include providing a first alfalfa plant having at least one mutation in an endogenous COMT allele, providing a second alfalfa plant having one or more functional COMT alleles, crossing the first alfalfa plant with the second alfalfa plant, thereby producing progeny seed, wherein the progeny seed produces plants that contain a mutation in at least one endogenous COMT allele.

In another aspect, this document provides a method for growing alfalfa plants with decreased lignin content and a reduction in syringyl (S) units as compared to a corresponding wild type alfalfa plant, plant part, or plant cell. The method can include planting seeds of alfalfa plants, wherein the alfalfa plants contain an induced mutation in one or more COMT alleles, and growing the alfalfa plants.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF DRAWINGS

FIG. 1 shows the coding sequence of a representative COMT mRNA sequence, from start to stop codon (SEQ ID NO:1); *Medicago sativa*, COMT coding sequence; GenBank accession number GU066087.1.

FIG. 2 shows a partial sequence of the COMT gene identified within a plant from the variety *Medicago sativa* SW 8421-S(SEQ ID NO:9).

FIG. 3 shows a partial sequence of the COMT gene identified within a plant from the variety *Medicago sativa* SW 8421-S(SEQ ID NO:10).

FIG. 4 shows a partial sequence of the COMT gene identified within a plant from the variety *Medicago sativa* SW 8421-S(SEQ ID NO:11).

FIG. 5 shows a partial sequence of the COMT gene identified within a plant from the variety *Medicago sativa* SW 8421-S(SEQ ID NO:12).

FIG. 6 shows a partial sequence of the COMT gene identified within a plant from the variety *Medicago sativa* SW 8421-S(SEQ ID NO:13).

FIG. 7 shows a partial sequence of the COMT gene identified within a plant from the variety *Medicago sativa* SW 8421-S(SEQ ID NO:14).

FIG. 8 shows a partial sequence of the COMT gene identified within a plant from the variety *Medicago sativa* SW 8421-S(SEQ ID NO:15).

FIG. 9 shows the genotype of a *Medicago saliva* SW8421-S T0 plant (designated as Ms491-1) containing three mutant COMT alleles (SEQ ID NOS:32526-32528) and one WI COMT allele, Ms491-1 was generated using the TALE nuclease pair MsCOMT_T01.1 which binds to SEQ ID NO:6.

FIG. 10 shows the genotype of a *Medicago saliva* SW8421-S T0 plant (designated as Ms491-2) containing four mutant COMT alleles (SEQ ID NOS:32529-32532). Ms491-2 was generated using the TALE nuclease pair MsCOMT_T02.1 which binds to SEQ ID NO:7.

FIG. 11 shows the genotype of a *Medicago saliva* SW8421-S T0 plant (designated as Ms589-1) containing four mutant COMT alleles (SEQ ID NOS:32533-32536). Ms589-1 was generated using the TALE nuclease pair MsCOMT_T03.1 which binds to SEQ ID NO:7.

FIG. 12 shows the genotype of a *Medicago saliva* SW8421-S T0 plant (designated as Ms553-1) containing one mutant COMT allele (SEQ ID NO:32537) and three WT COMT allele. Ms553-1 was generated using the TALE nuclease pair MsCOMT_T02.1 which binds to SEQ ID NO:7.

DETAILED DESCRIPTION

Figure 13:
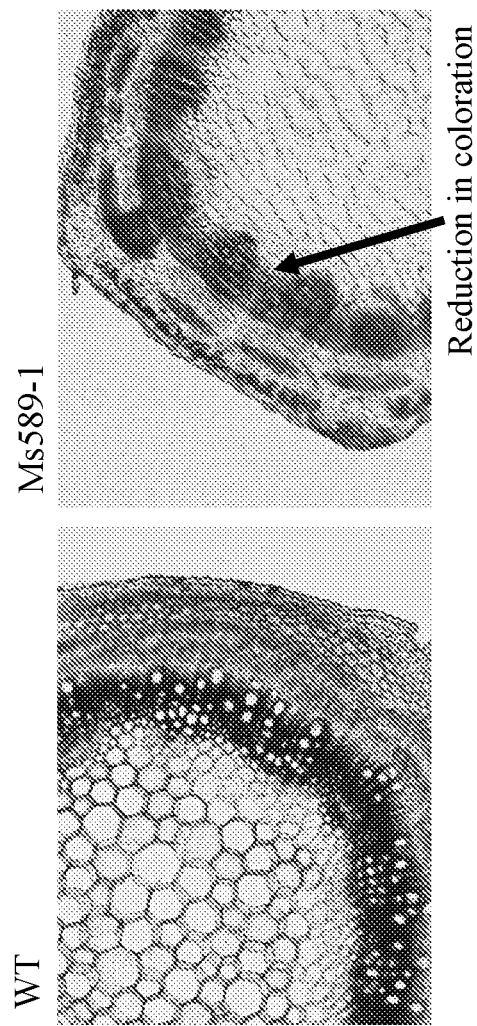
FIG. 13 shows the results of Maule staining from mutant line Ms589-1.

This document provides materials and methods for generating alfalfa plants with enhanced feed value. For example, this document provides materials and methods for creating alfalfa plants with enhanced feed value using sequence-specific nucleases to inactivate and/or attenuate alleles of the COMT gene.

Lignin plays important roles in plant development and function. For example, lignin can act as a physical barrier to help reduce microbial attacks, provides structural support for plants, and can facilitate water transport. Lignin in dicotyledonous plants, including alfalfa, is composed of guaiacyl (G) and syringyl (S) monolignol units. G units are derived from caffeic acid, whereas S units are derived from sinapic acid.

The lignin biosynthesis pathway begins with the conversion of phenylalanine to cinnamic acid, which is catalyzed by the enzyme PAL. Next, the cinnamic acid is converted to p-coumaric acid by the enzyme C4H. The p-coumaric acid is converted to p-coumaric acid CoA by the enzyme 4CL. The p-coumaric acid CoA is then converted to p-coumaraldehyde by the enzyme CCR or converted to caffeoyl CoA by the enzyme HCT/C3H. The p-coumaraldehyde is converted to p-coumaryl alcohol by the enzyme CAD, which is used to form H-lignin. The caffeoyl CoA is converted to feruloyl CoA by the enzyme CCoAOMT. The feruloyl CoA is then converted to coniferaldehyde by the enzyme CCR. The coniferaldehyde is then converted to either coniferyl alcohol for G-lignin synthesis, or converted into 5-hydroxyconiferaldehyde by the enzyme CAld5H. The 5-hydroxyconiferaldehyde is then converted into sinapaldehyde by the enzyme COMT. The sinapaldehyde is then converted to sinapyl alcohol by the enzyme CAD, where sinapyl alcohol is used to make S-lignin.

In some embodiments, a plant used for COMT inactivation or attenuation can be an alfalfa plant (*Medicago sativa*) or another member of the *Medicago* genus (e.g., *Medicago murex, Medicago falcata, Medicago prostrata,* or *Medicago truncatula*). In some cases, the plant can be a hybrid between any members of the *Medicago* genus. The alfalfa plant can be an alfalfa plant that is commonly referred to as a cultivated alfalfa plant, a diploid alfalfa plant, a glandular alfalfa plant, a purple-flowered alfalfa plant, a sickle alfalfa plant, a variegated alfalfa plant, a wild alfalfa plant, or a yellow-flowered alfalfa plant.

COMT is a small molecule S-adenosyl-L-Met-dependent O-methyltransferase (OMT), which catalyzes the conversion of 5-hydroxyconiferaldehyde to sinapaldehyde. The coding sequence, not including genomic introns, for a representative *Medicago* species (*Medicago sativa*) COMT gene is set forth SEQ ID NO:1 as shown in FIG. 1. The genomic sequence, including genomic introns, for another representative *Medicago* species (*Medicago truncatula*) COMT gene is shown below and in SEQ ID NO:32524. Upper case letters indicate exons. Lower case letters indicate introns.

(SEQ ID NO: 32524)

```
ATGGGTTCAACAGGTGAAACTCAAATAACACCAACTCACATATCAGATGAAGAAGC

AAACCTCTTCGCCATGCAACTAGCAAGTGCCTCAGTTCTTCCCATGGTTTTAAAATC

AGCTCTTGAACTTGATCTCTTAGAAATCATTGCTAAAGCTGGACCTGGTGCTCAAAT

TTCACCTATTGAAATTGCTTCTCAGCTCCCAACAACTAACCCTGAAGCACCGGTTAT

GCTGGACCGTATCTTGCGTCTATTGGCTTGTTACAATATCCTCACTTGTTCTGTTCGT

ACTCAACAAGATGGAAAGGTTCAGAGACTTTATGGTTTGGCTACTGTTGCTAAGTAT

TTGGTTAAGAATGAAGATGGTGTATCCATTTCTGCTCTTAACCTCATGAATCAGGAT

AAAGTTCTCATGGAAAGCTGGTAtttcactatttcctattctctgttttttactctgttttttattttgctctgttctctgttttattggt actaagaatagatgtgatatattctgaaaatgtgtttacaactgacagatagttctgacttactaattctaggacgaggagtgttaaaatttaccttt agattttgatatggggtaaatataaatgaacaaaatgggtgaatggatcacttagtggaacaatgtttctttactaataattaaaaactagcagg atatggaattatgattgaatcaaattccatatacaacatatttaacacataaataagtgaccaaatatgattggttaggttgttaagattgtgattcat actccactcagattgataaataatctatcagtattttttaacaaatgtgctttaactttaagacatattctagctttaagacacaccttaaacataaaat aaaatcataaaacacatcaacaacaaaatgtgagaattagcacccaaaaaaaaaaaaagaattggaatttgtattcattattctagttagctt ttttgtccttctctctttcccgacgggttattcagtaagctatagacactagacataaatgcagaaatttaaaattcatatgtctttgtaaaatagtac aaagtaacaagaaacccccgtaaaaaaaaaaaacaaattataggtgggaaaacacgtatttgtaaaatagttaccttttcttagggaacttctac ggtacattcacaaaataaggtgtaccggtactcttgatcataattttataaattaacgataattttttatgtaataaataactatttgttaatatttatatt ttatataacatcatttagaaaaaacatcatttcattgtttataagaattatagtaattattttttacatattattgtaaaaaataatcaatgttctcaattac gagtgataaaaattcaaaaaaattaattttatttcgttgacacttttgatgaataagatttagttgttataattataaatgataaaaaaataatatttact taaaaaaacaactcttttaactattaatttaaagagtggatgtatcggtacactcaaatatattgggtgtaccatataatttatcctgctcatattact
```

-continued

```
cagatcatacgcatatttgcttagagaaataatcatgggtcggtgaccgattaaattgacaactacgtagatatctcatagtatatgagaatattt
gtttttgatgcattataatttgtttcttacaatgtagtttacgccttctcatacattttgttctcatggagaggctggaaatctaaattttgtatagaat
atacattattttaaaatgtaacgtttgagactcgatgaacatttagaaaacacaattaatggattacaaaaatgaaatgttttcatttgcacgggaa
gttaacgtgtaagttaattattcataagatttaattactccataatggttcttttgaagaaaattaagaatgtttatttagttaaaattttatggttggtttt
tttttagaggattttatggtaagggattattgcaataaactcgtgtcaattattaagaggaaattgattaatacatggacgatgattatccagaaac
actaacctcaaagagttgaaacactaccatcaaagagttgtgttatttgaacatccatatatatgataacttttgtgacaaccaaaattaaaaa
aaaaaaaaggtagtgatacaaaaactaaacaataaaaaaaaaataaaaaaataatgtaagtatgaaatagaaagttgtcacaaaaattataa
aaaataattgttcaaatatcatttctcaacttcgaaagtttcaaattatgacatgatgatgacctagagggaccccccatttttgagtggccacca
actcactattcaacatttctgcatttcacctaccaccaatggagtgtgaaccaatcttcctgcaaagctttcaatagcaatatgaacagttagaca
atttcgtaatagtccaagttgtttgtcaaagctcaagactattatggttttacgtacatgtcaacattaaaagaaatcgagtagttgaacgaacttttt
gcatatagcattaagggttaaaaagttttatcccctttattcggggtcttttggtttatcctcctatggaataaaacttggagatttcctcctataaa
ataaagattttttgtttactctcctcccccacagccaacagtcagcatctgattgaataaatttgatgacatggcgtgctgacacgatatttttat
ttttttgaatttccatgtggcataatttaaaaaaaaaaaaaaactttttataaacacaaaaaaccttttattttgaaaaaaatctgaactttttaaa
aaccccaaattatttaaaaacattcagattttttaattttttttttaattttgtttttattaattttgataattaaatttcataactattaaatatctt
cttaattaaaaaaaaatctgaattttttctaattttaaatttcgaaataaaaaccccagatttttaaaaacattgagatttttaatttgata
attaaatttcaaaacttttaaatatcttcttaatttaaaaaaaatctgaattattttttctaatttaatttcaaaataaaaccccagatttta
aaaacattgagatttttaatttctatttttatttgataattaaatttcaaaacttttaaatatcttcttaatttaaaacaaatctgaatttttt
ttctaatttttaaatttcgaaaaaaccccagatttttaatttcaatttttatttttataattaaatttcagaacttttaaatatattttaattaa
aaaaatcagattttaaattttgaaaaaaactccctatatttaaaagtagagaaaactcgaaattaaaattcagatttttttcaaaataaaagat
ttttgttttttttttataaattatgccgcgtggaaattaaaaaaaataaaataaaatattatgttagtagcaaatttatccattcagatgctgactattgg
ttgtggaggggtaaaccaaataatatttattttacagggaaaatctccaaaaaaaaaaattcataggagggtatacctaaaaagcctagtaaccctagtat
taattttgggtctcagataaaccaaaaaatggatagatctttgaacttaagaaaacttggtttggatgttacatatcaaccacaaagttaaaaaaatatg
tatagaatttgtttaatcacatttgacgttataacaaaaaatatcacatttgatgcatcaacattcaaacgatagtgttatgttgatcgaggagggtt
gagcctaacaaaaaatgataggctttcacagtgttatgaataaaatttttgaagaaaaaagaatctataaaaagaaaagtctcttattgtaatt
atataattcaacttaatcaatatggtttagtgaatagaatacatttttttaatatggaaaaatggtcccttaaaagtgagtgattatttcaagccaattc
acttttttgacataaaagcttatacaattattttctattaaaagtaacaaaatatcatcatgtcaaaattcattatattatcatgtcaaattattttttcctc
aaaaaaaaaaaaaatcactatgtctgttaagttaatttactttgagaaatgatatttgcacgaccactttctcataactttttgacaactttatacatt
atcctcttattcttcctcttccttttctctctccattggttttgaccaatgaaaagagagaaaaataagttttcacaaaagttgtcttatatggttgtt
caaataacactactcatttactttatagtgtgcgtttggtttggcggtgacgagaattgattttttatagaattgagtttgagagaattgattttgattaa
aagtgagttagatgtgaattgattttttgtttgaatacactttgttaaaagcgattcttatgaattgttgttgtttggatacattgaatcaaaattgctttta
gatgtataattaccaaaatagattttcaatttttttaattttttttttgtttcaaataattattttagtatacgtcgataataataattttatttaggggat
tgataataacttctttttttaaggaccataataataactttttttgttttgttgaagaaccataataaatattaataataacttaaaaactattttttttc
ctaaaaaaaatgtaaaaactaataaaaacatatagtagtaattaattaatgattataataaataacaaaggggaaggaacaaaacgcatagcaaa
acaaacagaaagaaatatacaaatttctggaagctacttgatgtgaagaaaacaaaaatagagatcctggaagttgcttgatgtgaaga
aaacaagaaaaaatgctgaatgctgagacagtgaatagaaacttaaatgggttgttcaagagggagagaaggaagaaaacgatataga
tctgaaagagaacgagatagatctgagggcaaagaaggaagaaatgagttttttaactgccaaatctacagtaaacaaaaattgatttggga
ttcaccgcagaaactaggaatatgatgagcttcagcagaactggcgtttgggcctaaaatcatgtttcctggaatcgcttttcttcatccaaac
aagataaaaattaggaaaacggtgtttgacaaaagaaacttaggtttggcttgtggaaaagtgatgccaaacacatacatagtggttctataca
catcattttgattatcaatatcctatggcatgaatgaactacaactagatatcttaaccatgtgattaggattttaatctccagcggtgtaggaaat
aatttttttttttgaataaagtatgaaataatatatgtttggtgatgtcaacactttaaatgaatctcgacatcttgagtaattagtcatcgacttctaatg
agagattgccgaagttaacccaaataatgggttatagtatacaagtaattaaattgttttctttacgagaaattgtattcatctcatgcttagatga
```

-continued

```
cataaaaaccttaaaataaagatgacataaaaacactttctattctgcaaaaacatcaacatccttccaattgcacacacattctctctattatgag aaatagtaatccttagtccttactcattgtaggtaCCACCTAAAAGATGCAGTCCTTGATGGGGGCATTCCA

TTCAACAAGGCTTATGGAATGACAGCCTTTGAATACCATGGAACAGATCCAAGGTTT

AACAAGGTTTTCAACAAGGGGATGTCTGATCACTCTACCATCACAATGAAGAAAATT

CTTGAGACCTACACAGGTTTTGAAGGCCTTAAATCTCTTGTTGATGTAGGTGGTGGT

ACTGGAGCTGTAATTAACACGATTGTCTCAAAATATCCCACCATTAAGGGTATTAAT

TTTGATTTACCCCATGTCATTGAAGATGCTCCATCTTATCCAGGtacttatttcttatgtttaaccgcg ctgcttagtttacatgtcattgtcttaaacaattagtattaggttttacagcatatttgaacaaaattacttactacaatatatgtagaattgacattgat gttttgtgtaggAGTTGAGCATGTTGGTGGAGACATGTTTGTCAGTATTCCAAAGGCTGATG CTGTTTTTATGAAGgtgcattttataaatcttacctaccctaacacaatgttttggccttcttctatacgctaacagtagcaccgaca cttgagatagaggaaatgtcaggtgtcattgtcaacatgtttatatccatgctttccataacatagttgttttagcctttacatttgatatacttcaaat catattcctcttgtttacataaaattcgcgaagagaataactctgtcactaaatttagaaatgcaatgaaagaaaggtttattttatattttttcttaact aaaatttgttactacattaatttttctgatagtatatgctaattatgatatcattttatatgcatataqTGGATTTGTCATGACTGGA

GTGATGAGCACTGCTTGAAATTTTTGAAGAACTGCTATGAAGCACTACCAGACAATG

GAAAAGTGATTGTGGCAGAATGCATACTTCCAGTGGCTCCAGATTCAAGCCTGGCCA

CAAAAGGTGTGGTTCACATTGATGCAATCATGTTGGCTCATAATCCAGGTGGGAAAG

AGAGAACACAGAAAGAGTTTGAGGATCTTGCCAAAGGTGCTGGATTCCAAGGTTTC

AAAGTTCATTGTAATGCTTTCAACACATACATCATGGAATTTCTTAAGAAGGTTTAA
```

Representative partial sequences for the COMT alleles of the variety *Medicago sativa* SW 8421-S are shown in FIGS. 2-8 (SEQ ID NOS:9-15, respectively).

The COMT protein has methyltransferase activity and can function on several substrates, including caffeate, 5-hydroxyferulate, caffeoyl aldehyde, caffeoyl alcohol, 5-hydroxyconiferaldehyde, and 5-hydroxyconiferyl alcohol. Amino acids that are important for COMT function include the amino acids that form the binding pockets for SAM/SAH and COMT substrates, and the amino acids that form the active site. Information regarding the crystal structure of COMT and the specific amino acids that form binding pockets and active sites can be found elsewhere (see, e.g., Zubieta et al., *Plant Cell*, 14:1265-1277, 2002).

Alfalfa and other *Medicago* plants are tetraploid, and mutations can be induced in one, two, three, or all four COMT alleles of a plant, plant part, or plant cell using the methods described herein. Mutations within COMT that can result in inactivation or attenuation of gene function can include deletions, insertions, and/or substitutions.

Deletions and insertions can range in size from one nucleotides (nt) to 200 or more nt (e.g., one to five nt, five to 10 nt, 10 to 15 nt, 15 to 20 nt, 20 to 30 nt, 30 to 40 nt, 40 to 50 nt, 50 to 75 nt, 75 to 100 nt, 100 to 150 nt, 150 to 200 nt, or more than 200 nt). A deletion may result in removal of 0.1% to 100% of a gene's coding sequence (e.g., 0.1 to 0.5%, 0.5 to 1%, 1 to 5%, 5 to 10%, 10 to 15%, 15 to 20%, 20 to 30%, 30 to 40%, 40 to 50%, 50 to 60%, 60 to 70%, 70 to 80%, 80 to 90%, or 90 to 100% of the coding sequence).

In some embodiments, deletions that result in inactivation or attenuation are frameshift mutations (i.e., −3N+1 and −3N+2; wherein N is a whole number that is greater than or equal to 1), and in some embodiments, insertions that result in inactivation or attenuation are frameshift mutations (i.e., 3N−1 and 3N−2; wherein N is a whole number that is greater than or equal to 1). An inactivating/attenuating frameshift may occur within an exon, after the start codon and before the codon that encodes the last amino acid that is important for protein function. For COMT, an inactivating/attenuating frameshift may occur before the codon that encodes the glutamic acid at amino acid position 329 of SEQ ID NO:32525. In other words, the frameshift can occur before the nucleotides at positions 1000 and 1002 in SEQ ID NO:1 or the corresponding nucleotides within SEQ ID NO:32524. Deletions that can result in inactivation or attenuation of the gene also may include in-frame deletions that remove codons encoding amino acids that are important for protein function. These amino acids include, but are not limited to, L136, H166, A162, H323, N324, M252, D251, L232, D206, V207, G208, G209, G210, T211, G212, K265, M180, N131, F176, H296, H166, H183, E329, E297, I319, M180, H269, D270, D231, and F176 of SEQ ID NO:32525. In some cases, a plant generated by the methods provided herein can have at least one COMT allele with an in-frame deletion of one or more (e.g., one, two, three, four, five, six, seven, eight, nine, ten, two or more, five or more, ten or more, two to ten, three to 15, five to 20, or ten to 50) consecutive codons.

Substitutions that can result in inactivation or attenuation can include mutations that result in an early stop codon. Typically, the early stop codon can occur within an exon, after the start codon and before the codon that encodes the last amino acid that is important for protein function. For COMT, such a substitution may occur before the codon that encodes the glutamic acid at amino acid position 329 of SEQ ID NO:32525. In other words, the substitution may occur before the nucleotides at position 1000 and 1002 in SEQ ID NO:1 or the corresponding nucleotides within SEQ ID NO:32524. Substitutions that can result in inactivation or attenuation also include mutations that result in aberrant intron splicing, and also substitutions that result in one or more amino acid substitutions within the COMT protein. Such substitutions can be at active or conserved sites within the COMT protein. These amino acids include, but are not limited to, L136, H166, A162, H323, N324, M252, D251, L232, D206, V207, G208, G209, G210, T211, G212, K265, M180, N131, F176, H296, H166, H183, E329, E297, I319, M180, H269, D270, D231, and F176 of SEQ ID NO:32525.

In some embodiments, this document provides mutant COMT proteins containing one to four (e.g., one, two, three, or four) amino acid changes that result in inactivation or attenuation of the COMT protein activity. The amino acid changes can be located at one or more of positions P67, T68, T69, and N70 of a COMT protein having the sequence of SEQ ID NO:32525 or a sequence with at least 90% identity to SEQ ID NO:32525. Thus, this document provides mutant COMT proteins containing one, two, three, or four amino acid changes at one or more of positions P67, T68, T69, and N70 of SEQ ID NO:32525 or a sequence with at least 90% identity to SEQ ID NO:32525. In some cases, the one or more amino acid changes can be a deletion of one or more amino acids [e.g., a deletion resulting from a deletion of the nucleotide codon(s) that code for the deleted amino acid(s)]. In some cases, the one or more amino acid changes can be a substitution of one or more amino acids (e.g., a substitution resulting from one or more nucleotide substitutions in a COMT coding sequence).

In some embodiments, this document provides mutant COMT proteins containing the amino acid sequence IASQLPDAPVML (SEQ ID NO:32538).

In some embodiments, this document provides mutant COMT proteins with one to three (e.g., one, two, or three) amino acid changes that result in inactivation or attenuation of the COMT protein activity. The amino acid changes can be located at one or more of positions I47, I48, and A49 of a COMT protein containing the amino acid sequence of SEQ ID NO:32525 or a sequence with at least 90% identity to SEQ ID NO:32525. Thus, this document provides mutant COMT proteins containing one, two, or three amino acid changes at one or more of positions I47, I48, and A49 of SEQ ID NO:32525 or a sequence with at least 90% identity to SEQ ID NO:32525. In some cases, the one or more amino acid changes can be a deletion of one or more amino acids [e.g., a deletion resulting from a deletion of the nucleotide codon(s) that encode the deleted amino acid(s)]. In some cases, the one or more amino acid changes can be a substitution of one or more amino acids (e.g., a substitution resulting from one or more nucleotide substitutions).

In some embodiments, this document provides mutant COMT proteins containing the amino acid sequence ELDL-LETKAGPGAQ (SEQ ID NO:32539).

To generate COMT-mutant plants, plants (e.g., alfalfa or other *Medicago* plants) can be regenerated from a cell, or a population of cells, that have been transformed with one or more sequence-specific nucleases. Numerous independent mutants are usually generated using each of one or more sequence-specific nucleases. Plants with specific COMT mutations can also be generated by crossing a first plant containing one or more sequence-specific nuclease-induced COMT mutations with a second plant that may or may not have one or more sequence-specific nuclease-induced COMT mutations. The resulting COMT-mutant plants can be evaluated in numerous ways, including (1) phenotyping the desired trait (e.g., lignin content and composition), (2) molecular characterization of the resulting plant to ensure no off-target mutations or random integration of foreign DNA, (3) segregation of the mutation(s) and phenotype, and (4) agronomic performance of the COMT-mutant plant.

In some embodiments, plants containing a mutation in a COMT allele also can contain a transgene. The transgene can be integrated into the alfalfa genome using standard transformation protocols. The transgene can result in the expression of a protein that confers tolerance or resistance to one or more herbicides (e.g., glufonsinate, mesotrione, imidazolinone, isoxaflutole, glyphosate, 2,4-D, hydroxyphenylpyruvate dioxygenase-inhibiting herbicides, or dicamba). The transgene can encode a plant 5-enolpyruvylshikimate-3-phosphate synthase (EPSPS) protein or a modified plant EPSPS protein, a bacterial EPSPS protein, wherein the modified plant EPSPS contains an amino acid substitution within the conserved TAI RP (SEQ ID NO:32522) sequence. The substitutions can include a threonine to isoleucine substitution, a proline to serine substitution, or a proline to adenine substitution. The transgene can encode a bacterial EPSPS protein, an *agrobacterium* CP4 EPSPS protein, an aryloxyalkanoate dioxygenase (AAD) protein, a phosphinothricin N-acetyltransferase (PAT) protein, an acetohydroxyacid synthase large subunit protein, a p-hydroxyphenylpyruvate dioxygenase (hppd) protein, or a dicamba monooxygenase (DMO) protein.

This document also provides nucleic acid molecules containing a COMT nucleotide sequence (e.g., any of SEQ ID NOS:1, 6-15, or 32524, or a fragment of any of SEQ ID NOS:1, 6-15, or 32524), but with one or more induced deletions, insertions, or nucleotide substitutions as compared to a corresponding wild type COMT nucleotide sequence. In some cases, for example, a nucleic acid molecule can include a nucleotide sequence as set forth in any of SEQ ID NOS:32526-32537. In some cases, a nucleic acid molecule can contain a nucleic acid sequence that encodes an alfalfa COMT polypeptide, provided that the nucleic acid sequence includes an in-frame deletion of at least three (e.g., three, six, nine, 12, 15, 18, three to 30, three to 60, three to 99, six to 30, six to 60, or six to 99) nucleotides as compared to a corresponding nucleic acid sequence that encodes a wild type alfalfa COMT polypeptide.

In some cases, a nucleic acid molecule can be an isolated nucleic acid molecule. The term "isolated," as used herein with reference to a nucleic acid, refers to a naturally-occurring nucleic acid that is not immediately contiguous with both of the sequences with which it is immediately contiguous (one on the 5' end and one on the 3' end) in the naturally-occurring genome of the organism from which it is derived. For example, an isolated nucleic acid can be a recombinant DNA molecule of any length, provided one of the nucleic acid sequences normally found immediately flanking that recombinant DNA molecule in a naturally-occurring genome is removed or absent. Thus, an isolated nucleic acid includes, without limitation, a recombinant DNA that exists as a separate molecule (e.g., a cDNA or a genomic DNA fragment produced by PCR or restriction endonuclease treatment) independent of other sequences, as well as recombinant DNA that is incorporated into a vector, an autonomously replicating plasmid, a virus (e.g., a retrovirus, adenovirus, or herpes virus), or into the genomic DNA of a prokaryote or eukaryote. In addition, an isolated nucleic acid can include a recombinant DNA molecule that is part of a hybrid or fusion nucleic acid sequence.

The term "isolated," as used herein with reference to a nucleic acid, also includes any non-naturally-occurring nucleic acid, since non-naturally-occurring nucleic acid sequences are not found in nature and do not have immediately contiguous sequences in a naturally-occurring genome. For example, a non-naturally-occurring nucleic acid such as an engineered nucleic acid or a nucleic acid containing a mutation induced by gene editing as described herein is considered to be an isolated nucleic acid. Engineered nucleic acids can be generated using molecular cloning or chemical nucleic acid synthesis techniques. An isolated, non-naturally-occurring nucleic acid can be independent of other sequences, or incorporated into a vector, an autonomously replicating plasmid, a virus (e.g., a retrovirus, adenovirus, or herpes virus), or the genomic DNA of a prokaryote or eukaryote. In addition, a non-naturally-occurring nucleic acid can include a nucleic acid molecule that is part of a hybrid or fusion nucleic acid sequence.

In some cases, a nucleic acid can have a nucleotide sequence with at least about 75% sequence identity to a representative COMT nucleotide sequence. For example, a nucleotide sequence can have at least 75, at least 80, at least 85, at least 90, at least 91, at least 92, at least 93, at least 94, at least 95, at least 96, at least 97, at least 98, or at least 99 percent sequence identity to a representative, naturally occurring COMT nucleotide sequence as set forth in any of SEQ ID NOS:1, 6-8, 9-15, and 32524. In some cases, an alfalfa plant, plant part, or plant cell as provided herein can have an induced mutation within a sequence as set forth in any of SEQ ID NOS:1, 6-8, 9-15, and 32524, or within a sequence having at least 90% (e.g., at least 91%, at least 92%, at least 93%, at least 94%, at least 95%, at least 96%, at least 97%, at least 98%, or at least 99%) identity so any of SEQ ID NOS:1, 6-8, 9-15, and 32524.

The percent sequence identity between a particular nucleic acid or amino acid sequence and a sequence referenced by a particular sequence identification number is determined as follows. First, a nucleic acid or amino acid sequence is compared to the sequence set forth in a particular sequence identification number using the BLAST 2 Sequences (B12seq) program from the stand-alone version of BLASTZ containing BLASTN version 2.0.14 and BLASTP version 2.0.14. This stand-alone version of BLASTZ can be obtained online at fr.com/blast or at ncbi.nlm.nih.gov. Instructions explaining how to use the B12seq program can be found in the readme file accompanying BLASTZ. B12seq performs a comparison between two sequences using either the BLASTN or BLASTP algorithm. BLASTN is used to compare nucleic acid sequences, while BLASTP is used to compare amino acid sequences. To compare two nucleic acid sequences, the options are set as follows: -i is set to a file containing the first nucleic acid sequence to be compared (e.g., C:\seq1.txt); -j is set to a file containing the second nucleic acid sequence to be compared (e.g., C:\seq2.txt); -p is set to blastn; -o is set to any desired file name (e.g., C:\output.txt); -q is set to -1; -r is set to 2; and all other options are left at their default setting. For example, the following command can be used to generate an output file containing a comparison between two sequences: C:\B12seq -i c:\seq1.txt -j c:\seq2.txt -p blastn -o c:\output.txt -q -1 -r 2. To compare two amino acid sequences, the options of B12seq are set as follows: -i is set to a file containing the first amino acid sequence to be compared (e.g., C:\seq1.txt); -j is set to a file containing the second amino acid sequence to be compared (e.g., C:\seq2.txt); -p is set to blastp; -o is set to any desired file name (e.g., C:\output.txt); and all other options are left at their default setting. For example, the following command can be used to generate an output file containing a comparison between two amino acid sequences: C:\B12seq c:\seq1.txt -j c:\seq2.txt -p blastp -o c:\output.txt. If the two compared sequences share homology, then the designated output file will present those regions of homology as aligned sequences. If the two compared sequences do not share homology, then the designated output file will not present aligned sequences.

Once aligned, the number of matches is determined by counting the number of positions where an identical nucleotide or amino acid residue is presented in both sequences. The percent sequence identity is determined by dividing the number of matches either by the length of the sequence set forth in the identified sequence (e.g., SEQ ID NO:1), or by an articulated length (e.g., 100 consecutive nucleotides or amino acid residues from a sequence set forth in an identified sequence), followed by multiplying the resulting value by 100. For example, an amino acid sequence that has 700 matches when aligned with the sequence set forth in SEQ ID NO:1 is 63.8 percent identical to the sequence set forth in SEQ ID NO:1 (i.e., 700/1098×100=63.8). It is noted that the percent sequence identity value is rounded to the nearest tenth. For example, 75.11, 75.12, 75.13, and 75.14 is rounded down to 75.1, while 75.15, 75.16, 7.17, 75.18, and 7.19 is rounded up to 7.2. It also is noted that the length value will always be an integer.

In some embodiments, the methods described herein involve the delivery of genome engineering reagents to plant cells from alfalfa or other *Medicago* species. Any suitable method can be used to introduce the nucleic acid into plant cells. In some embodiments, for example, a method as provided herein can include contacting a plant cell with an organism that is capable of horizontal gene transfer (e.g., a bacterium, such as an *Agrobacterium*), where the organism contains a Ti or Ri plasmid, or T-DNA plasmid having a T-DNA region that includes the promoter, UTRs, coding sequence, and a poly-A tail. Methods for *Agrobacterium*-mediated transformation in alfalfa are described elsewhere (see, e.g., Tohidfar et al., *Plant Cell, Tissue and Organ Culture*, 113:227-235, 2013.) In other embodiments, a method for introducing genome editing reagents as provided herein can include biolistic transformation, electroporation-mediated transformation, or polyethylene glycol-mediated transformation of alfalfa plant cells (e.g., protoplasts. The protoplasts can be obtained from hypocotyl or leaf tissue. Plants containing mutations or TALE nuclease DNA can be regenerated using standard plant regeneration protocols. See, for example, Atanassov et al., *Plant Cell, Tissue and Organ Culture*, 3:149-162, 1984.

In some embodiments, the methods described herein can include determining the level and composition of lignin in alfalfa or another *Medicago* species. Several methods can be employed to measure lignin levels and composition, including Maule staining, acid detergent fiber, acid detergent lignin, Klason, permanganate, and acetyl bromide lignin methods. Details about these methods is provided elsewhere (see, e.g., Hatfield and Fukushima, *Crop Science*, 45:832-839, 2005). For the Maule staining method, see, Guo et al., *Plant Cell*, 13: 73-88, 2001 and Mitra and Logue *Journal of visualized experiments*, 87: 51381, 2014. For the Klason method, see, Lin and Dence, *Methods in Lignin Chemistry*, 217-232, 1992. Thioacidolysis can be used to estimate the relative abundance and total yield of β-O-4 linked S, G, and H monolignols. See, for example, Foster et al., *J Vis Exp*, 37:5-8, 2010; and Wang et al., *Proc Natl Acad Sci USA*, 107:22338-22343). For example, samples can be reacted with BF3 etherate in a dioxane/ethanethiol mixture. The individual lignin monomers then can be assessed using gas chromatography mass spectrometry (GC/MS), and quantified by gas chromatography. A reduction in S-lignin content within a COMT mutant plant can suggest that the COMT mutations reduce the conversion of 5-hydroxyconiferaldehyde to sinapaldehyde, which subsequently results in plants with reduced S-lignin.

In some embodiments, the methods described herein can include identifying the intended gene edit. Several means can be employed to identify the desired targeted insertion. One means is polymerase chain reaction (PCR), in which primers are designed to amplify DNA encompassing the TALE nuclease target site. The PCR product can be cloned and sequenced using standard DNA sequencing techniques to verify successful targeted mutagenesis.

As used herein, the amino acid sequences follow the standard single letter or three letter nomenclature. All protein or peptide sequences are shown in conventional format where the N-terminus appears on the left and the carboxyl group at the C-terminus on the right. Amino acid nomenclature, both single letter and three letter, for naturally occurring amino acids are as follows: alanine (Ala; A), asparagine (Asn; N), aspartic acid (Asp; D), arginine (Arg; R), cysteine (Cys; C), glutamic acid (Glu; F), glutamine (Gln; glycine (Gly; G), histidine (His; H), leucine (Leu; L), isoleucine (Ile; lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

As used herein, "progeny" includes any plant, seed, plant cell, and/or a regenerated plant part comprising a non-naturally occurring mutation in the COMT gene derived from an ancestor plant. Progeny may contain non-naturally occurring mutations in one, two, three, or four of the COMT alleles.

The term "allele(s)" means any of one or more alternative forms of a gene at a particular locus. In a diploid (or amphidiploid) cell of an organism, alleles of a given gene are located at a specific location or locus on a chromosome. One allele is present on each chromosome of the pair of homologous chromosomes. "Heterozygous" alleles are two different alleles residing at a specific locus, positioned individually on corresponding pairs of homologous chromosomes. "Homozygous" alleles are two identical alleles residing at a specific locus, positioned individually on corresponding pairs of homologous chromosomes in the cell. As used herein, "backcrossing" refers to a repetitive crossing of hybrid plants, where, for example, a first-generation hybrid is crossed back to one of the parents of the hybrid progeny, Backcrossing can be used to transfer one or more loci from one genetic background to a different genetic background.

As used herein, "crossing" refers to the mating of two parent plants, wherein the pollen of one parent is transferred to the stigma of the second parent. Crossing can be used to transfer one or more specific alleles to a different plant with a different genetic background. Crossing can be used to create a population of alfalfa plants with a desired trait, wherein the population comprises alfalfa plants with different genetic backgrounds. Here, the alfalfa plants comprising different genetic backgrounds are crossed to plants comprising an allele that produces a desired trait. Crossing, backcrossing and breeding can be carried out via known procedures. DNA fingerprinting, SNP or similar technologies may be used in a marker-assisted selection (MAS) breeding program to transfer or breed mutant COMT alleles into other alfalfa plants. For example, a breeder can create segregating populations from hybridizations of a genotype containing a mutant allele with an agronomically desirable genotype. Plants in the F2 or backcross generations can be screened using markers developed from COMT sequences or fragments thereof. Plants identified as possessing the mutant allele can be backcrossed or self-pollinated to create a second population to be screened. Depending on the expected inheritance pattern or the MAS technology used, it may be necessary to self-pollinate the selected plants before each cycle of backcrossing to aid identification of the desired individual plants. Backcrossing or other breeding procedure can be repeated until the desired phenotype of the recurrent parent is recovered. The result of a plant breeding program using the mutant alfalfa plants described herein can be novel and useful lines and varieties. As used herein, the term "variety" refers to a population of plants that share constant characteristics which separate them from other plants of the same species. With respect to alfalfa, a variety can refer to a population of alfalfa with different genetic backgrounds. A variety is often, although not always, sold commercially. While possessing one or more distinctive traits, a variety can be further characterized by a very small overall variation between individuals within that variety. A "pure line" variety may be created by several generations of self-pollination and selection, or vegetative propagation from a single parent using tissue or cell culture techniques. A variety can be essentially derived from another line or variety. As defined by the International Convention for the Protection of New Varieties of Plants (Dec. 2, 1961, as revised at Geneva on Nov. 10, 1972, on Oct. 23, 1978, and on Mar. 19, 1991), a variety is "essentially derived" from an initial variety if: a) it is predominantly derived from the initial variety, or from a variety that is predominantly derived from the initial variety, while retaining the expression of the essential characteristics that result from the genotype or combination of genotypes of the initial variety; b) it is clearly distinguishable from the initial variety; and c) except for the differences which result from the act of derivation, it conforms to the initial variety in the expression of the essential characteristics that result from the genotype or combination of genotypes of the initial variety. Essentially derived varieties can be obtained, for example, by the selection of a natural or induced mutant, a somaclonal variant, a variant individual from plants of the initial variety, backcrossing, or transformation. A "line" as distinguished from a variety most often denotes a group of plants used non-commercially, for example in plant research. A line typically displays little overall variation between individuals for one or more traits of interest, although there may be some variation between individuals for other traits.

As used herein, the term "explant" refers to a section of plant cells or plant parts that are taken from a donor plant and used for culturing.

As used herein, the term "Neutral Detergent Fiber Digestibility" or "NDFD" refers to the digestibility of a forage fiber. NDFD can be measured in vitro and predicted using techniques such as Near Infrared Reflectance Spectroscopy. NDFD also can be measured by incubating forages with rumen fluid for a specific period of time. A high NDFD value indicates more digestible forage, whereas a low NDFD value indicates less digestible forage.

The term "reduced lignin content" refers to any reduction in the amount of lignin in an alfalfa plant, plant part, or plant cell generated by a method described herein, as compared to the amount of lignin in a corresponding wild type alfalfa plant, plant part, or plant cell. In some embodiments, the lignin content can be reduced by at least 3% (e.g., at least 5%, at least 10%, at least 20%, at least 25%, at least 30%, at least 40%, at least 50%, at least 60%, at least 70%, at least 80%, or at least 90%), as compared to the lignin content in a corresponding wild type plant, plant part, or plant cell.

The term "reduced syringyl (S) units" refers to any reduction in the amount of syringyl (S) units in an alfalfa plant, plant part, or plant cell generated by a method described herein, as compared to the amount of syringyl (S) units in a corresponding wild type alfalfa plant, plant part, or plant cell. In some embodiments, the syringyl (S) unit content can be reduced by at least 3% (e.g., at least 5%, at least 10%, at least 20%, at least 25%, at least 30%, at least 40%, at least 50%, at least 60%, at least 70%, at least 80%, or at least 90%), as compared to the syringyl (S) unit content in a corresponding wild type plant, plant part, or plant cell.

The term "increased NDFD" refers to any increase in the NDFD level in an alfalfa plant, plant part, or plant cell generated by a method described herein, as compared to the NDFD level in a corresponding wild type alfalfa plant, plant part, or plant cell. In some embodiments, the NDFD level can be increased by at least 3% (e.g., at least 5%, at least 10%, at least 20%, at least 25%, at least 30%, at least 40%, at least 50%, at least 60%, at least 70%, at least 80%, or at least 90%), as compared to the NDFD level in a corresponding wild type plant, plant part, or plant cell.

The term "induced mutation" as used herein refers to a mutation introduced by human intervention. An "induced mutation" can be a mutation that was introduced using a sequence-specific nuclease, for example. In some cases, the sequence-specific nuclease used to induce a mutation can be a meganuclease, a TALE nuclease, a zinc-finger nuclease, or a clustered regularly interspaced short palindromic repeats/CRISPR-associated (CRISPR/Cas system nuclease. In some cases, an "induced mutation" can be a mutation that was introduced using a chemical substance, such as ethylmethylsulfonate (EMS) or ethylnitrosourea (ENU). Further, an "induced mutation" can be a mutation that was introduced using ionizing radiation, such as neutron radiation (e.g., fast neutron mutagenesis), gamma rays, or X-rays.

"Wild type" as used herein refers to a typical form of a plant or a gene as it most commonly occurs in nature. For example, a "wild type COMT allele" is a naturally occurring COMT allele (e.g., as found within naturally occurring alfalfa plants) that encodes a functional COMT protein, while a "mutant COMT allele" is a COMT allele that does not encode a functional COMT protein or encodes an attenuated COMT protein. Such a "mutant COMT allele" can include one or more mutations in its nucleic acid sequence, where the mutation(s) result in no detectable amount of functional COMT protein in the plant or plant cell in vivo.

As used herein, the term "functional variant" is intended to refer to a catalytically active mutant of a protein or a protein domain. Such a mutant can have the same level of activity, or a higher or lower level of activity as compared to the parent protein or protein domain.

As used herein, "nuclear localization sequence" and "NLS" and "NLS tag" refer to an amino acid sequence that facilitates trafficking to the plant cell nucleus, Nuclear localization sequence and NLS and NLS tag can also refer to the nucleotide sequence that codes for an amino acid sequence that facilitates trafficking to the plant cell nucleus. Argonaute and Ago proteins can contain NLS tags. The NLS tag can be located within the Argonaute and Ago protein sequence. The NLS tag can be added to the C-terminus. N-terminus or central portion of the Argonaute and Ago protein. Preferably, the NLS tag is near the N-terminus of the Argonaute and Ago protein.

As used herein, the term "uncharged polar" amino acids include glycine, serine, threonine, cysteine, tyrosine, asparagine and glutamine. The term "nonpolar" amino acids include alanine, valine, leucine, isoleucine, proline, phenylalanine, tryptophan, and methionine. The term "charged polar" amino acids includes aspartic acid, glutamic acid, lysine, arginine and histidine.

As used herein, "deoxyribonucleic acid" and "DNA" refer to a biopolymer that comprises four nucleotides linked together by phosphodiester bridges. The four nucleotides include dAMP (2'-deoxyadenosine-5-monophosphate), dGMP (2'-deoxyguanosine-5-monophosphate), dCMP (2'-deoxycytosine-5-monophosphate) and dTMP (2'-deoxythymosine-5-monophosphate).

As used herein, the term "codon" refers to nucleotide triplets which code for amino acids. Due to the redundancy of the genetic code, the same amino acid can be coded for by different codons. The following is a list of amino acids and their respective codons: Met (ATG); Glu (GAA, GAG); Val (GTA, GTC, GTG, GTT); Arg (CGA, CGC, CGG, CGT, AGA, AGG); Leu (CTA, CTC, CTG, CTT, TTA, TTG); Ser (TCA, TCC, TCG, TCT, AGC, AGT); Thr (ACA, ACC, ACG, ACT); Pro (CCA, CCC, CCG, CCT); Ala (GCT, GCA, GCC, GCG); Gly (GGA, GGC, GGG, GGT); Ile (ATA, ATC, ATT); Lys (AAA, AAG); Asn (AAC, AAT); Gln (CAG, CAA); His (CAC, CAT); Asp (GAC, GAT); Tyr (TAC, TAT); Cys (TGC, TGT); Phe (TTC, TTT); and Trp (UGG).

As used herein, the terms "plant" and "plant part" refer to cells, tissues, organs, seeds, and severed parts (e.g., roots, stems, leaves, and flowers) that retain the distinguishing characteristics of the parent plant. "Seed" refers to any plant structure that is formed by continued differentiation of the ovule of the plant, following its normal maturation point at flower opening, irrespective of whether it is formed in the presence or absence of fertilization and irrespective of whether or not the seed structure is fertile or infertile.

As referred to herein, "coding sequence" or "CDS" refers to DNA that harbors the necessary information that is required to produce a functional RNA or protein. Coding sequence or CDS can include a DNA sequence starting with ATG and ending with a stop codon. The coding sequence or CDS usually does not contain introns, if no introns are required to produce the functional RNA or protein.

The term "rare-cutting endonucleases" herein refer to natural or engineered proteins having endonuclease activity directed to nucleic acid sequences having a recognition sequence (target sequence) about 12-40 bp in length (e.g., 14-40 bp in length). Typical rare-cutting endonucleases cause cleavage inside their recognition site, leaving 4 nt staggered cut with 3'OH or 5'OH overhangs. These rare-cutting endonucleases may be meganucleases, such as wild type or variant proteins of homing endonucleases, more particularly belonging to the dodecapeptide family (LAGLI-DADG (SEQ ID NO:32523; see, WO 2004/067736) or may result from fusion proteins that associate a DNA binding domain and a catalytic domain with cleavage activity. TAL effector endonucleases and zinc finger nucleases (ZFN) are examples of fusions of DNA binding domains with the catalytic domain of the endonuclease FokI. Customized TAL effector endonucleases are commercially available under the trade name TALEN™ (Cellectis, Paris, France). For a review of rare-cutting endonucleases, see Baker, Nature Methods 9:23-26, 2012.

As referred to herein, "plant" can refer to crop plants, or monocots and dicots. Examples of a crop plants include soybean, wheat, alfalfa, potato, rice, corn, millet, barley, tomato, apple, pear, strawberry, orange, watermelon, pepper, carrot, sugar beets, yam, lettuce, spinach, sunflower, and rape seed, a flowering plant, such as *petunia*, rose, and

*chrysanthemum*, conifers and pine trees, a plant used in phytoremediation (e.g., heavy metal-accumulating plants), and a plant used for experimental purposes (e.g., *Arabidopsis*). The plant can be a monocot or a dicot. Examples of monocots include, without limitation, wheat, maize, rice, orchids, onion, aloe, true lilies, grasses (e.g., *setaria*), woody shrubs and trees (e.g., palms and bamboo), and food plants such as pineapple and sugar cane. Examples of dicots include, without limitation, tomato, cassava, soybean, tobacco, potato, *Arabidopsis*, rose, pansy, sunflower, grape, strawberry, squash, bean, pea, and peanut. Orders of dicots include Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salcicales, Capparales, Ericales, Diapensales, Ebenales, Primulales, Rosales, Fabales, Podostemales, Haloragales, Myrtales, Cornales, Proteales, Santalales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Camapnulales, Rubiales, Dipsacales, and Asterales. Genera of dicots include *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Galucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapsis, Solanum, Theobroma, Trifolium, Trigonella, Vicia, Vinca, Vilis*, and *Vigna*. Orders of monocots include Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales. Genera of monocots include *Allium, Andropogon, Aragrostis, Asparagus, Avena, Cynodon, Elaeis, Festuca, Festulolium, Heterocallis, Hordeum, Lemna, Lolium, Musa, Oryza, Panicum, Pannesetum, Phleum, Poa, Secale, Sorghum, Triticum*, and *Zea*. Other plants include Gymnospermae, such as the orders Pinales, Ginkgoales, Cycadales, and Gnetales, such as the genera *Abies, Cunninghamia, Picea, Pinus*, and *Pseudotsuga*, such as fir and pine.

"Mutagenesis" as used herein refers to processes in which mutations are introduced into a selected DNA sequence. Mutations induced by endonucleases generally are obtained by a double-strand break, which results in insertion/deletion mutations ("indels") that can be detected by deep-sequencing analysis. Such mutations typically are deletions of several base pairs, and have the effect of inactivating the mutated allele. In the methods described herein, for example, mutagenesis occurs via double-stranded DNA breaks made by nucleases targeted to selected DNA sequences in a plant cell. Such mutagenesis results in "nuclease-induced mutations" (e.g., nuclease-induced knockouts, such as TALE-nuclease-induced knockouts) and reduced expression of the targeted gene. Following mutagenesis, plants can be regenerated from the treated cells using known techniques (e.g., planting seeds in accordance with conventional growing procedures, followed by self-pollination).

Methods for selecting endogenous target sequences and generating TALE nuclease pairs targeted to such sequences can be performed as described elsewhere. See, for example, PCT Publication No. WO 2011/072246, which is incorporated herein by reference in its entirety. In some embodiments, software that specifically identifies TALE nuclease recognition sites, such as TALE-NT 2.0 (Doyle et al., *Nucl Acids Res* 40:W117-122, 2012) can be used.

Transcription activator-like (TAL) effectors are found in plant pathogenic bacteria of the genus *Xanthomonas*. These proteins play important roles in disease, or trigger defense, by binding host DNA and activating effector-specific host genes (see, e.g., Gu et al., *Nature* 435:1122-1125, 2005; Yang et al., *Proc Natl Acad Sci USA* 103:10503-10508, 2006; Kay et al., *Science* 318:648-651, 2007; Sugio et al., *Proc Natl Acad Sci USA* 104:10720-10725, 2007; and Römer et al., *Science* 318:645-648, 2007). Specificity depends on an effector-variable number of imperfect, typically 34 amino acid repeats (Schornack et al., *J Plant Physiol* 163:256-272, 2006; and WO 2011/072246). Polymorphisms are present primarily at repeat positions 12 and 13, which are referred to as the repeat variable-diresidue (RVD).

The RVDs of TAL effectors correspond to the nucleotides in their target sites in a direct, linear fashion, one RVD to one nucleotide, with some degeneracy and no apparent context dependence. This mechanism for protein-DNA recognition enables target site prediction for new target specific TAL effectors, as well as target site selection and engineering of new TAL effectors with binding specificity for the selected sites.

TAL effector DNA binding domains can be fused to other sequences, such as endonuclease sequences, resulting in chimeric endonucleases targeted to specific, selected DNA sequences, and leading to subsequent cutting of the DNA at or near the targeted sequences. Such cuts (i.e., double-stranded breaks) in DNA can induce mutations into the wild type DNA sequence via non-homologous end joining (NHEJ) or homologous recombination, for example. In some cases, TALE nucleases can be used to facilitate site directed mutagenesis in complex genomes, knocking out or otherwise altering gene function with great precision and high efficiency. As described in the Examples below, TALE nucleases targeted to the alfalfa COMT alleles can be used to mutagenize the endogenous alleles, resulting in plants without detectable expression (or reduced expression) of COMT. The fact that some endonucleases (e.g., FokI) function as dimers can be used to enhance the target specificity of the TALE nuclease. For example, in some cases a pair of TALE nuclease monomers targeted to different DNA sequences can be used. When the two TALE nucleases recognition sites are in close proximity, the inactive monomers can come together to create a functional enzyme that cleaves the DNA. By requiring DNA binding to activate the nuclease, a highly site-specific restriction enzyme can be created.

Methods for using TALE nucleases to generate alfalfa plants, plant cells, or plant parts having mutations in endogenous genes include, for example, those described in the Examples herein. For example, one or more nucleic acids encoding TALE nucleases targeted to conserved nucleotide sequences present in one or more COMT alleles can be transformed into plant cells or plant parts, where they can be expressed. In some cases, one or more TALE nuclease proteins can be introduced into plant cells or plant parts. The cells or plant parts, or a plant cell line or plant part generated from the cells, can subsequently be analyzed to determine whether mutations have been introduced at the target site(s), through next-generation sequencing techniques (e.g., 454 pyrosequencing or illumina sequencing) or conventional sequencing methods (e.g., Sanger sequencing). The template for sequencing can be, for example, the TALE nuclease target site within a COMT gene sequence that is amplified by PCR using primers that are homologous to conserved nucleotide sequences across all COMT alleles.

RNA-guided systems also can be used in the methods provided herein. For example, the CRISPR/Cas systems use RNA to direct DNA cleavage (see, e.g., Belahj et al., *Plant Methods* 9:39, 2013). This system consists of a Cas9 endonuclease and a guide RNA (either a complex between a CRISPR RNA [crRNA] and trans-activating crRNA [tracrRNA], or a synthetic fusion between the 3' end of the crRNA and 5' end of the tracrRNA). The guide RNA directs Cas9 binding and DNA cleavage to sequences that are adjacent to a proto-spacer adjacent motif (PAM; e.g., NGG for Cas9 from *Streptococcus pyogenes*). Once at the target DNA sequence, Cas9 generates a DNA double-strand break at a position three nucleotides from the 3' end of the crRNA sequence that is complementary to the target sequence. As there are several PAM motifs present in the nucleotide sequence of the COMT alleles, the CRISPR/Cas system may be employed to introduce mutations within the COMT alleles within alfalfa plant cells in which the Cas9 endonuclease and the guide RNA are transfected and expressed. This approach can be used as an alternative to TALE nucleases in some instances, to obtain plants and plant parts as described herein.

The term "expression" as used herein refers to the transcription of a particular nucleic acid sequence to produce sense or antisense RNA or mRNA, and/or the translation of an mRNA molecule to produce a polypeptide, with or without subsequent post-translational events.

The term "modulating" as used herein refers to increasing or decreasing translational efficiency of an mRNA. This can be accomplished by inserting, removing, or altering a 5' UTR sequence, a 3' UTR sequence, or 5' and 3' UTR sequences.

As used herein, the term "nucleic acid" refers to a polymer made up of nucleotide monomers. A nucleic acid can be single stranded or double stranded, and can be linear or circular. Where single-stranded, a nucleic acid can be a sense strand or an antisense strand. A nucleic acid can be composed of DNA (e.g., cDNA, genomic DNA, synthetic DNA, or a combination thereof), RNA, or DNA and RNA. Further, nucleic acids can contain information for gene expression, including, but not limited to, promoters, 5' UTRs, 3' UTRs, coding sequences, and terminators.

A "vector" is a replicon, such as a plasmid, phage, or cosmid, into which another DNA segment may be inserted so as to bring about the replication of the inserted segment. Generally, a vector is capable of replication when associated with the proper control elements. Suitable vector backbones include, for example, those routinely used in the art such as plasmids, viruses, artificial chromosomes, BACs, YACs, or PACs. The term "vector" includes cloning and expression vectors, as well as viral vectors and integrating vectors. An "expression vector" is a vector that includes one or more expression control sequences, and an "expression control sequence" is a DNA sequence that controls and regulates the transcription and/or translation of another DNA sequence. Suitable expression vectors include, without limitation, plasmids and viral vectors derived from, for example, bacteriophage, baculoviruses, tobacco mosaic virus, herpes viruses, cytomegalovirus, retroviruses, vaccinia viruses, adenoviruses, and adeno-associated viruses. Numerous vectors and expression systems are commercially available from such corporations as Novagen (Madison, Wis.), Clontech (Palo Alto, Calif.), Stratagene (La Jolla, Calif.), and Invitrogen/Life Technologies (Carlsbad, Calif.).

The terms "regulatory region," "control element," and "expression control sequence" refer to nucleotide sequences that influence transcription or translation initiation and rate, and stability and/or mobility of the transcript or polypeptide product. Regulatory regions include, without limitation, promoter sequences, enhancer sequences, response elements, protein recognition sites, inducible elements, promoter control elements, protein binding sequences, 5' and 3' UTRs, transcriptional start sites, termination sequences, polyadenylation sequences, introns, and other regulatory regions that can reside within coding sequences, such as secretory signals, Nuclear Localization Sequences (NLS) and protease cleavage sites.

As used herein, "operably linked" means incorporated into a genetic construct so that expression control sequences effectively control expression of a coding sequence of interest. A coding sequence is "operably linked" and "under the control" of expression control sequences in a cell when RNA polymerase is able to transcribe the coding sequence into RNA, which if an mRNA, then can be translated into the protein encoded by the coding sequence. Thus, a regulatory region can modulate, e.g., regulate, facilitate or drive, transcription in the plant cell, plant, or plant tissue in which it is desired to express a modified target nucleic acid.

In addition, in some embodiments in which a plant part or plant cell is used, the methods provided herein can include regenerating a plant from the plant part or plant cell. The methods also can include breeding the plant (e.g., the plant into which the nucleic acids were introduced, or the plant obtained after regeneration of the plant part or plant cell used as a starting material) to obtain a genetically desired plant lineage. Methods for regenerating and breeding plants are well established in the art.

This document also provides containers (e.g., bags) of alfalfa seeds, where at least one seed in the container has an induced mutation in one or more COMT alleles. For example, at least one seed in the container can have an induced mutation in one COMT allele, induced mutations in two COMT alleles, induced mutations in three COMT alleles, or induced mutations in all four COMT alleles. In some cases, a plant grown from the at least one seed can exhibit a reduction in lignin S units as compared to a corresponding wild type alfalfa plant, reduced lignin content as compared to a corresponding wild type plant, or a reduction in both S units and lignin content as compared to a corresponding wild type plant. In some cases, at least 10 percent (e.g., at least 25 percent, at least 50%, at least 75%, or at least 90%) of the seeds within the container can have an induced mutation in each of the four COMT alleles.

The invention will be further described in the following examples, which do not limit the scope of the invention described in the claims.

EXAMPLES

Example 1—Design of TALE Nucleases Targeting COMT in *Medicago sativa*

To identify potential target sequences for TALE nucleases, regions within the COMT gene were sequenced. A first pair of PCR primers were designed to recognize and amplify a region encompassing the first exon of COMT (TABLE 1).

A second pair of PCR primers were designed to recognize and amplify a region encompassing the second through fourth exons of COMT.

TABLE 1

Primers for sequencing the Medicago sativa COMT gene

| Primer name | Description | Sequence | SEQ ID NO: |
|---|---|---|---|
| CLSSL127 | MsCOMT forward primer | CCTCATCAATCACAACCATGGG | 2 |
| CLSSL128 | MsCOMT reverse primer | AGCAACAGTAGCCAAACCAT | 3 |
| CLSSL129 | MsCOMT forward primer | GTGGTGGTACTGGAGCTGTA | 4 |
| CLSSL130 | MsCOMT reverse primer | ACTCAGATGCAACACACCAA | 5 |

DNA was extracted from the Medicago sativa variety SW 8421-S. Due to the tendency for heterozygosity within alfalfa varieties, tissue samples from fifteen individual plants from the SW 8421-S variety were isolated. DNA was prepared using standard CTAB-based methods (Murray and Thompson, Nucl Acids Res, 8:4321-4325, 1980). Primers shown in TABLE 1 were used to amplify the COMT gene. Resulting PCR amplicons were cloned and sequenced. From each plant, 16 total PCR clones were generated (eight PCR clones for each of the two primer pairs). A publically available COMT mRNA sequence was used as a reference sequence for alignment (SEQ ID NO:1). Sequences were aligned using the CLUSTALW algorithm and a consensus sequence for the COMT locus was elucidated.

Multiple alleles were identified at the 5' end of the COMT gene using primer pairs CLSSL127 and CLSSL128. Sequenced portions of the COMT gene, comprising allele-defining SNPs, are shown in FIGS. 2-8 and SEQ ID NOS: 9-15.

Three TALE nuclease pairs were designed to target sequences within the 5' end of the COMT gene. The three TALE nuclease pairs were named MsCOMT_T01.1, MsCOMT_T02.1, and MsCOMT_T03.1. The TALE nuclease pairs and their predicted target sequences are shown in TABLE 2. Underlined nucleotides represent the TALE nuclease binding sites.

TABLE 2

TALE nuclease target sequences within the Medicago sativa COMT gene

| TALE nuclease target | Target sequence | SEQ ID NO: |
|---|---|---|
| MsCOMT_T01.1 | TTCAACAGGTGAAACTCAAATAACACCAACCCAC ATATCAGATGAAGAA | 6 |
| MsCOMT_T02.1 | TGAACTTGATCTCTTAGAAATCATTGCTAAAGCT GGACCTGGTGCTCAA | 7 |

TABLE 2-continued

TALE nuclease target sequences within the Medicago sativa COMT gene

| TALE nuclease target | Target sequence | SEQ ID NO: |
|---|---|---|
| MsCOMT_T03.1 | TTGCTTCTCAGCTACCAACAACTAACCCTGATGC ACCAGTTATGTTGGA | 8 |

Example 2—Assessing the Activity of TALE Nucleases Targeting COMT in Medicago sativa To assess the activity of the COMT-targeting TALE nuclease pairs, a protoplast transformation experiment was performed. Alfalfa protoplasts were isolated from leaves of plants grown in vitro. Plants were grown in vitro for 12 days before leaves were collected. Leaves were digested in an enzyme solution containing 2% cellulase and 0.8% macerozyme. The enzyme solution was placed in a 25 C incubator and shaken at 35 rpm for approximately 16 hours. Following digestion, protoplasts were isolated using conventional protoplast isolation techniques. Specifically, protoplasts were filtered through a 100 um cell strainer into a 50 mL conical tube. Cells were pelleted by centrifugation at 100 g for 5 minutes. Supernatant was removed and the pellet was resuspended in 10 mL of CPW-13 medium. Protoplasts were pelleted by centrifugation at 100 g for 5 minutes. Supernatant was removed and the pellet was resuspended in 5 mL of CPW-13 medium. Protoplasts were transferred to at 15 mL tube containing 5 mL of 0.55 M sucrose. Samples were centrifuged at 1000 g for 5 minutes. Protoplasts at the top of the sucrose cushion were removed and transferred to a new 50 mL conical tube containing 5 mL CPW-13. Cells were centrifuged at 100 g for 5 min. Supernatant was removed and cells were resuspended in 2 mL of CPW-13. Cells were counted using a hemocytometer. Protoplasts (150,000 per sample) were transformed in a solution comprising 20% polyethylene glycol and 30 µg of TALE nuclease-encoded plasmid DNA (i.e., 15 µg of plasmid encoding each TALE nuclease monomer). Following transformation, cells were washed three times in CPW-13. After the three washes, cells were resuspended in K8P solution and incubated at 28° C. Two days post transformation, protoplasts were collected and DNA was extracted. TALE nuclease target sites were amplified by PCR, and the resulting amplicons were deep sequenced using illumina sequencing.

All three TALE nuclease pairs had activity at their predicted target sequences. The mutation frequency (i.e., the number of mutant sequences divided by the total number of sequences) of TALE nuclease pair McCOMT_T01.1 was 12.58%. The mutation frequency of TALE nuclease pair McCOMT_T02.1 was 15.95%. The mutation frequency of TALE nuclease pair McCOMT_T03.1 was 14.12%.

COMT mutations within alfalfa cells were further analyzed. Both insertions and deletions were observed, with the majority of the mutations being deletions. With respect to TALE nuclease pair MsCOMT_T01.1, it was observed that the majority of mutations resulted in deletion of the nucleotide at position 7 of 15 in the spacer. Specifically, with respect to TALE nuclease pair MsCOMT_T01.1, a deletion of the cytosine at position 29 of SEQ ID NO:1 was observed in the majority of the mutations. With respect to TALE nuclease pair MsCOMT_T02.1, it was observed that the majority of mutations resulted in deletion of the nucleotide at position 8 of 15 in the spacer. Specifically, with respect to TALE nuclease pair MsCOMT_T02.1, a deletion of the thymine at position 144 of SEQ ID NO:1 was observed in the majority of the mutations. With respect to TALE nuclease pair MsCOMT_T03.1, it was observed that the majority of mutations resulted in deletion of the nucleotide at position 7 of 15 in the spacer. Specifically, with respect to TALE nuclease pair MsCOMT_T03.1, a deletion of the adenine at position 208 of SEQ ID NO:1 was observed in the majority of the mutations.

A list of COMT sequences containing TALE nuclease-induced mutations, both insertions and deletions, that were identified within alfalfa cells is provided by SEQ ID NOS: 16-32521. Specifically, COMT sequences containing TALE nuclease-induced mutations from TALE nuclease pair MsCOMT_T01.1 is provided by SEQ ID NOS:16-10038. COMT sequences containing TALE nuclease-induced mutations from TALE nuclease pair MsCOMT_T02.1 are set forth in SEQ ID NOS:10039-22042. COMT sequences containing TALE nuclease-induced mutations from TAT E nuclease pair MsCOMT_T03.1 are set forth in SEQ ID NOS:22043-32521. Any of the mutations within SEQ ID NOS:16-32521 can be used to create an alfalfa plant with lower lignin content. Any of the mutations within SEQ ID NOS:16-32521, including the mutations that result in frameshifts, can be used (introduced into one COMT allele, introduced into two COMT alleles, introduced into three COMT allele, introduced into all COMT alleles) to create an alfalfa plant with lower lignin content. Mutations within SEQ ID NOS:16-32521 can be combined into two, three, or all COMT alleles to create an alfalfa plant with lower lignin content.

In addition to SW8421-S, TALE nucleases were transformed into protoplasts from the variety SW9337. Protoplasts from both varieties were regenerated for approximately 1 month until visible calli appeared. Calli were regenerated from protoplasts using conventional alfalfa regeneration techniques; see, for example, Monteiro et al., *Scientia Agricola,* 60:683-689, 2003; Kao et al., *Zeitschrift für Pflanzenphysiologie,* 96:135-141, 1980; Song et al., *Plant Protoplasts and Genetic Engineering IV,* 60-70, 1993; Johnson et al., *Plant Sciences Letters,* 1981. Three to five different calli from both varieties were isolated and DNA was extracted. The DNA was used as a template in a PCR with primers designed to amplify the corresponding MsCOMT TALE nuclease target sites. Resulting amplicons were deep sequenced and the mutation frequency was calculated (Table 3). Mutations were observed at the MsCOMT TALE nuclease target sites in calli from both alfalfa varieties.

TABLE 3

Mutation frequency in calli from alfalfa varieties SW8421-S and SW9337

| Exp. Name | Plant Variety | TALE nuclease (Ms) | NHEJ % | # of Events | Insertion | Deletion |
| --- | --- | --- | --- | --- | --- | --- |
| Ms291 | Ms (SW8421-S) | COMT_T01 | 15.90% | 18297 | 0 | 18297 |
| Ms291 | Ms (SW8421-S) | COMT_T01 | 3.38% | 5348 | 7 | 5347 |
| Ms291 | Ms (SW8421-S) | COMT_T01 | 12.64% | 23496 | 19 | 23495 |
| Ms291 | Ms (SW8421-S) | COMT_T01 | 15.18% | 25791 | 6 | 25791 |
| Ms291 | Ms (SW8421-S) | COMT_T01 | 10.05% | 914 | 9 | 909 |
| Ms292 | Ms (SW9337) | COMT_T02 | 1.46% | 1444 | 5 | 1444 |
| Ms292 | Ms (SW9337) | COMT_T02 | 2.57% | 5462 | 9 | 5462 |
| Ms292 | Ms (SW9337) | COMT_T02 | 4.72% | 13185 | 9 | 13185 |
| Ms292 | Ms (SW9337) | COMT_T02 | 4.07% | 21259 | 383 | 20899 |
| Ms292 | Ms (SW9337) | COMT_T02 | 5.16% | 16353 | 132 | 16352 |
| Ms293 | Ms (SW8421-S) | COMT_T03 | 3.01% | 6106 | 61 | 6046 |
| Ms293 | Ms (SW8421-S) | COMT_T03 | 9.39% | 11790 | 3 | 11790 |
| Ms293 | Ms (SW8421-S) | COMT_T03 | 2.66% | 4673 | 4 | 4673 |
| Ms293 | Ms (SW8421-S) | COMT_T03 | 3.41% | 6820 | 89 | 6736 |
| Ms293 | Ms (SW8421-S) | COMT_T03 | 0.38% | 383 | 1 | 383 |
| Ms294 | Ms (SW9337) | COMT_T01 | 8.32% | 17587 | 26 | 17586 |
| Ms294 | Ms (SW9337) | COMT_T01 | 8.89% | 9511 | 3 | 9511 |
| Ms294 | Ms (SW9337) | COMT_T01 | 15.60% | 10890 | 203 | 10690 |
| Ms294 | Ms (SW9337) | COMT_T01 | 12.91% | 20769 | 6 | 20769 |
| Ms294 | Ms (SW9337) | COMT_T01 | 19.16% | 61371 | 8 | 61371 |
| Ms295 | Ms (SW8421-S) | COMT_T02 | 8.95% | 28664 | 105 | 28566 |
| Ms295 | Ms (SW8421-S) | COMT_T02 | 16.69% | 23970 | 60 | 23912 |
| Ms295 | Ms (SW8421-S) | COMT_T02 | 14.66% | 27415 | 122 | 27301 |
| Ms295 | Ms (SW8421-S) | COMT_T02 | 11.87% | 29330 | 24 | 29311 |
| Ms295 | Ms (SW8421-S) | COMT_T02 | 9.66% | 21890 | 133 | 21771 |
| Ms296 | Ms (SW9337) | COMT_T03 | 9.02% | 8517 | 20 | 8499 |
| Ms296 | Ms (SW9337) | COMT_T03 | 9.53% | 37797 | 10 | 37797 |
| Ms296 | Ms (SW9337) | COMT_T03 | 19.61% | 20926 | 1 | 20926 |
| Ms296 | Ms (SW9337) | COMT_T03 | 19.57% | 62917 | 6 | 62916 |
| Ms296 | Ms (SW9337) | COMT_T03 | 28.00% | 80526 | 7 | 80526 |
| Ms378 | Ms (SW8421-S) | COMT_T01 | 14.48% | 10975 | 2 | 10974 |
| Ms378 | Ms (SW8421-S) | COMT_T01 | 0.84% | 957 | 25 | 949 |
| Ms378 | Ms (SW8421-S) | COMT_T01 | 1.64% | 6959 | 478 | 6484 |
| Ms379 | Ms (SW9337) | COMT_T02 | 23.20% | 80877 | 23 | 80856 |
| Ms379 | Ms (SW9337) | COMT_T02 | 25.25% | 48369 | 1 | 48368 |
| Ms379 | Ms (SW9337) | COMT_T02 | 38.90% | 72786 | 55 | 72742 |
| Ms380 | Ms (SW8421-S) | COMT_T03 | 24.59% | 57058 | 10 | 57056 |
| Ms380 | Ms (SW8421-S) | COMT_T03 | 22.36% | 33671 | 18 | 33671 |
| Ms380 | Ms (SW8421-S) | COMT_T03 | 26.30% | 79438 | 6 | 79438 |
| Ms381 | Ms (SW9337) | COMT_T01 | 5.70% | 15486 | 4 | 15486 |
| Ms381 | Ms (SW9337) | COMT_T01 | 0.05% | 58 | 0 | 58 |
| Ms381 | Ms (SW9337) | COMT_T01 | 19.55% | 29888 | 3 | 29888 |

TABLE 3-continued

Mutation frequency in calli from alfalfa varieties SW8421-S and SW9337

| Exp. Name | Plant Variety | TALE nuclease (Ms) | NHEJ % | # of Events | Insertion | Deletion |
|---|---|---|---|---|---|---|
| Ms382 | Ms (SW8421-S) | COMT_T02 | 15.80% | 18525 | 97 | 18432 |
| Ms382 | Ms (SW8421-S) | COMT_T02 | 27.94% | 70020 | 3 | 70020 |
| Ms382 | Ms (SW8421-S) | COMT_T02 | 39.99% | 134865 | 13 | 134865 |
| Ms383 | Ms (SW9337) | COMT_T03 | 23.43% | 77793 | 6 | 77792 |
| Ms383 | Ms (SW9337) | COMT_T03 | 16.01% | 69574 | 8 | 69574 |
| Ms383 | Ms (SW9337) | COMT_T03 | 10.80% | 23277 | 2 | 23277 |
| Ms384 | Ms (SW8421-S) | None | 0.09% | 150 | 2 | 150 |
| Ms385 | Ms (SW8421-S) | None | 0.05% | 57 | 1 | 57 |

Example 3—Regenerating Alfalfa Plants with Mutations in COMT

To regenerate alfalfa plants comprising mutations within the COMT gene, protoplasts from SW8421-S and 9337 lines were transformed with DNA encoding functional TALE nuclease pairs and regenerated into whole plants. Alfalfa protoplasts were isolated from tissue of plants grown in vitro. Plants were grown in vitro for approximately 1-2 weeks before tissue is collected. Leaves were digested in an enzyme solution containing 2% cellulase and 0.8% macerozyme. The enzyme solution was placed in a 25° C. incubator and shaken at 35 rpm for approximately 16 hours. Following digestion, protoplasts were isolated using conventional protoplast isolation techniques. Specifically, protoplasts were filtered through a 100 um cell strainer into a 50 mL conical tube. Cells were pelleted by centrifugation at 100 g for 5 minutes. Supernatant was removed and the pellet is resuspended in 10 mL of CPW-13 medium. Protoplasts were pelleted by centrifugation at 100 g for 5 minutes, Supernatant was removed and the pellet was resuspended in 5 mL of CPW-13 medium. Protoplasts were transferred to at 15 mL tube containing 8 mL of 0.55 M sucrose. Samples were centrifuged at 1000 g for 5 minutes. Protoplasts at the top of the sucrose cushion were removed and transferred to a new 50 mL conical tube containing 5 mL CPW-13. Cells were centrifuged at 100 g for 5 min, Supernatant was removed and cells are resuspended in 2 mL of CPW-13, Cells were counted using a hemocytometer. Protoplasts (150,000 per sample) were transformed in a solution comprising 20% polyethylene glycol and 30 μg of TALE nuclease -encoded plasmid DNA (i.e., 15 μg of plasmid encoding each TALE nuclease monomer). Following transformation, cells were washed three times in CPW-13. After the three washes, cells were resuspended in K8P solution and incubated at 28° C.

Plants were regenerated from protoplasts using conventional alfalfa regeneration techniques; see, for example, Monteiro et al., Scientia Agricola, 60:683-689, 2003; Kao et al., Zeitschrift für Pflanzenphysiologie, 96:135-141, 1980; Song et al., Plain Protoplasts and Genetic Engineering IV, 60-70, 1993; Johnson et al., Plant Sciences Letters, 1981.

Individual alfalfa plants that were regenerated from protoplasts were then advanced to molecular screening.

Example 4—Screening Alfalfa Plants for Mutations in COMT

DNA was extracted from alfalfa plants using standard. CTAB-based methods (Murray and Thompson, Nucl Acids Res, 8:4321-4325, 1980). Forward primer TCTCACAAAAACCTCATCAATCAC (SEQ ID NO:32540) and reverse primer TTAGCAACAGTAGC-CAAACC (SEQ ID NO:32541) were used in a PCR to amplify the corresponding TALE nuclease target site within the COMT gene. Resulting DNA amplicons were cloned and sequenced.

A first plant (designated as Ms491-1) was identified to harbor deletions in three of the four COMT alleles (FIG. 9). Plant Ms491-1, derived from line 8421-S, was generated using TALE nuclease pair MsCOMT_T01.1, which binds to SEQ NO: 6. The three mutant alleles harbored deletions of 5 bp (SEQ ID NO:32526), 10 bp (SEQ ID NO:32527), and 13 bp (SEQ ID NO:37578).

A second plant (designated as Ms492-2) was identified to harbor deletions in four of the four COMT alleles (FIG. 10). Plant Ms492-2, derived from line 8421-S, was generated using TALE nuclease pair MsCOMT_T02.1, which binds to SEQ ID NO: 7. The four mutant alleles harbored deletions of 16 bp (SEQ ID NO:32530), 11 bp (SEQ ID NO:32529), 10 bp (SEQ ID NO:32532) and 6 bp (SEQ ID NO:32531).

A third plant (designated as Ms589-1) was identified to harbor deletions in four of the four COMT alleles (FIG. 11). Plant Ms589-1, derived from line 9337, was generated using TALE nuclease pair MsCOMT_T03.1, which binds to SEQ ID NO: 8. The four mutant alleles harbored deletions of 12 bp (SEQ ID NO:32533), 30 bp (SEQ ID NO:32534), 20 bp (SEQ ID NO:32535) and 57 bp (SEQ ID NO:32536).

A fourth plant (designated as Ms553-1) was identified to harbor deletions in one of the four cam alleles (FIG. 12). Plant Ms553-1, derived from line 9337, was generated using TALE nuclease pair MsCOMT_T02.1, which binds to SEQ ID NO:7. The mutant allele harbored a deletion of 10 bp (SEQ ID NO:32537).

Alfalfa plants containing mutations in COMT alleles were advanced to phenotypic analysis. Mutations can consist of deletions, substitutions and/or insertions.

Example 5—Phenotyping COMT-Mutant Alfalfa Plants for Lignin Content

Alfalfa plants having mutations in COMT alleles are assessed for lignin content and lignin composition. Lignin content is assessed using the acid detergent lignin method from AOAC (AOAC Official Method 973.18), or using the acetyl bromide method described elsewhere (Fukushima and Hatfield, J Agri Food Chem, 52:3713-3720, 2004). A decrease in total lignin content suggests mutations in COMT can result in alfalfa plants with reduced lignin.

The Maule staining method adapted from Mitra and Logue (J Visualized Experiments, 87:51381, 2014) was used assess lignin composition. Briefly, stems from five-week old alfalfa plants were hand-sectioned and transferred to a 2.0 ml microcentrifuge tube. After adding 1 ml of the 0.5% potassium permanganate solution (stored in a dark bottle at room temperature) to the tube containing the sections, the solution was mixed by pipetting up and down gently without disturbing the sections. Once all the sections were settled down, 700 µl of 0.5% potassium permanganate solution was drawn out using a 1 nil pipette, then washed 3-4 times with 700 µl of distilled water until the water solution stays clear. The water was discarded, and 1 ml of 3% HO was added (prepared fresh on the day of the experiment) until the deep brown color was discharged from the sections. 3% HO solution was pipetted out and 1 ml of concentrated ammonium hydroxide solution (14.8 M, stored at 4° C.) was added. Sections were drawn out using a pipet with a cut pipet tip. The sections were dispensed onto a microscope slide and covered with a coverslip for observation under bright-field lighting. The Maule stain is specific for detecting the S units in xylem and interfascicular fibers. Red coloration indicates the presence of S units in the lignin elements. Plants with mutations in COMT displayed a reduced red coloration and lower level of S lignin.

Figure 14:
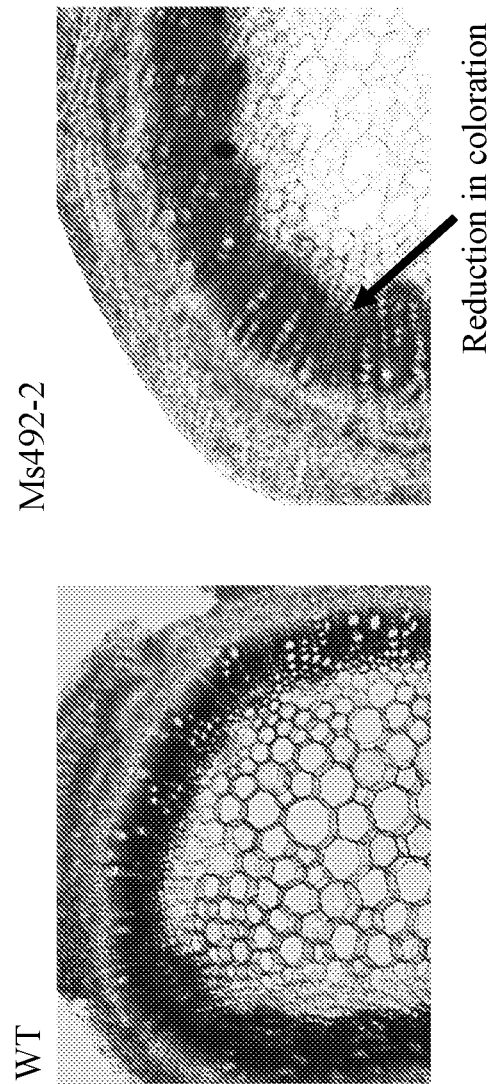
FIG. 14 shows the results of Maule staining from mutant line Ms492-2.

Phenotyping of plant Ms589-1 (FIG. 13) and Ms492-2 (FIG. 14) by Maule staining showed a reduction in red coloration in both plants, indicating a reduction in S units.

Example 6 Breeding Alfalfa Plants Comprising Mutations within COMT

Alfalfa plants having induced mutations in COMT alleles are crossed to generate a series of plants containing combinations of mutations within the four COMT alleles. TABLE 4 lists the plants generated in a representative breeding program.

TABLE 4

Alfalfa lines with mutations in COMT alleles
"−10 bp a" refers to the 10 bp deletion originating from plant Ms491-1
"−10 bp b" refers to the 10 bp deletion originating from plant Ms491-2
"−10 bp c" refers to the 10 bp deletion originating from plant Ms553-1

| Plant | Allele 1 | Allele 2 | Allele 3 | Allele 4 |
|---|---|---|---|---|
| MsC001 | wt | wt | −10 bp a | −10 bp a |
| MsC002 | wt | wt | −10 bp a | −13 bp |
| MsC003 | wt | wt | −13 bp | −13 bp |
| MsC004 | wt | −5 bp | −10 bp a | −10 bp a |
| MsC005 | wt | −5 bp | −10 bp a | −13 bp |
| MsC006 | wt | −5 bp | −13 bp | −13 bp |
| MsC007 | −5 bp | −5 bp | −10 bp a | −10 bp a |
| MsC008 | −5 bp | −5 bp | −10 bp a | −13 bp |
| MsC009 | −5 bp | −5 bp | −13 bp | −13 bp |
| MsC010 | −11 bp | −11 bp | −6 bp | −6 bp |
| MsC011 | −11 bp | −11 bp | −6 bp | −10 bp b |
| MsC012 | −11 bp | −11 bp | −10 bp b | −10 bp b |
| MsC013 | −11 bp | −16 bp | −6 bp | −6 bp |
| MsC014 | −11 bp | −16 bp | −6 bp | −10 bp b |
| MsC015 | −11 bp | −16 bp | −10 bp b | −10 bp b |
| MsC016 | −16 bp | −16 bp | −6 bp | −6 bp |
| MsC017 | −16 bp | −16 bp | −6 bp | −10 bp b |
| MsC018 | −16 bp | −16 bp | −10 bp b | −10 bp b |
| MsC019 | −12 bp | −12 bp | −20 bp | −20 bp |
| MsC020 | −12 bp | −12 bp | −20 bp | −57 bp |
| MsC021 | −12 bp | −12 bp | −57 bp | −57 bp |
| MsC022 | −12 bp | −30 bp | −20 bp | −20 bp |
| MsC023 | −12 bp | −30 bp | −20 bp | −57 bp |
| MsC024 | −12 bp | −30 bp | −57 bp | −57 bp |
| MsC025 | −30 bp | −30 bp | −20 bp | −20 bp |
| MsC026 | −30 bp | −30 bp | −20 bp | −57 bp |
| MsC027 | −30 bp | −30 bp | −57 bp | −57 bp |
| MsC028 | wt | wt | wt | wt |
| MsC029 | wt | −10 bp c | wt | wt |
| MsC030 | −10 bp c | −10 bp c | wt | wt |
| MsC031 | wt | wt | wt | −10 bp a |
| MsC032 | wt | wt | −13 bp | −10 bp a |
| MsC033 | wt | −5 bp | wt | −10 bp a |

TABLE 4-continued

Alfalfa lines with mutations in COMT alleles
"−10 bp a" refers to the 10 bp deletion originating from plant Ms491-1
"−10 bp b" refers to the 10 bp deletion originating from plant Ms491-2
"−10 bp c" refers to the 10 bp deletion originating from plant Ms553-1

| Plant | Allele 1 | Allele 2 | Allele 3 | Allele 4 |
|---|---|---|---|---|
| MsC034 | wt | −5 bp | wt | −13 bp |
| MsC035 | wt | −11 bp | wt | −6 bp |
| MsC036 | wt | −11 bp | wt | −10 bp b |
| MsC037 | wt | −16 bp | wt | −6 bp |
| MsC038 | wt | −16 bp | wt | −10 bp b |
| MsC039 | wt | wt | wt | −20 bp |
| MsC040 | wt | wt | wt | −57 bp |
| MsC041 | wt | −12 bp | wt | −20 bp |
| MsC042 | wt | −12 bp | wt | −57 bp |
| MsC043 | wt | −16 bp | −6 bp | −10 bp b |
| MsC044 | −11 bp | −5 bp | −6 bp | −10 bp b |
| MsC045 | −11 bp | −16 bp | −6 bp | −13 bp |
| MsC046 | wt | −5 bp | −6 bp | −10 bp b |
| MsC047 | wt | −16 bp | −10 bp a | −10 bp b |
| MsC048 | wt | −16 bp | −6 bp | −13 bp |
| MsC049 | −11 bp | −5 bp | −10 bp a | −10 bp b |
| MsC050 | −11 bp | −5 bp | −6 bp | −13 bp |
| MsC051 | −11 bp | −16 bp | −10 bp a | −13 bp |
| MsC052 | wt | −5 bp | −6 bp | −13 bp |
| MsC053 | wt | −16 bp | −10 bp a | −13 bp |
| MsC054 | −11 bp | −5 bp | −10 bp a | −13 bp |
| MsC055 | wt | −30 bp | −20 bp | −57 bp |
| MsC056 | −12 bp | −5 bp | −20 bp | −57 bp |
| MsC057 | −12 bp | −30 bp | −10 bp a | −57 bp |
| MsC058 | −12 bp | −30 bp | −20 bp | −13 bp |
| MsC059 | wt | −5 bp | −20 bp | −57 bp |
| MsC060 | wt | −30 bp | −10 bp a | −57 bp |
| MsC061 | wt | −30 bp | −20 bp | −13 bp |
| MsC062 | −12 bp | −5 bp | −10 bp a | −57 bp |
| MsC063 | −12 bp | −5 bp | −20 bp | −13 bp |
| MsC064 | −12 bp | −30 bp | −10 bp a | −13 bp |
| MsC065 | wt | −5 bp | −10 bp a | −57 bp |
| MsC066 | wt | −5 bp | −20 bp | −13 bp |
| MsC067 | wt | −30 bp | −10 bp a | −13 bp |
| MsC068 | −12 bp | −5 bp | −10 bp a | −13 bp |
| MsC069 | wt | −5 bp | wt | wt |
| MsC070 | wt | −10 bp c | −10 bp a | wt |
| MsC071 | wt | −10 bp c | wt | −13 bp |
| MsC072 | wt | −5 bp | −10 bp a | wt |
| MsC073 | wt | −10 bp c | −10 bp a | −13 bp |
| MsC074 | −11 bp | −30 bp | −20 bp | −57 bp |
| MsC075 | −12 bp | −16 bp | −20 bp | −57 bp |
| MsC076 | −12 bp | −30 bp | −6 bp | −57 bp |
| MsC077 | −12 bp | −30 bp | −20 bp | −10 bp b |
| MsC078 | −11 bp | −16 bp | −20 bp | −57 bp |
| MsC079 | −11 bp | −30 bp | −6 bp | −57 bp |
| MsC080 | −11 bp | −30 bp | −20 bp | −10 bp b |
| MsC081 | −12 bp | −16 bp | −6 bp | −57 bp |
| MsC082 | −12 bp | −16 bp | −20 bp | −10 bp b |
| MsC083 | −12 bp | −30 bp | −6 bp | −10 bp b |
| MsC084 | −11 bp | −16 bp | −6 bp | −57 bp |
| MsC085 | −11 bp | −16 bp | −20 bp | −10 bp b |
| MsC086 | −11 bp | −30 bp | −6 bp | −10 bp b |
| MsC087 | −12 bp | −16 bp | −6 bp | −10 bp b |
| MsC088 | −11 bp | −10 bp c | wt | wt |
| MsC089 | wt | −16 bp | wt | wt |
| MsC090 | wt | −10 bp c | −6 bp | wt |
| MsC091 | wt | −10 bp c | wt | −10 bp b |
| MsC092 | −11 bp | −16 bp | wt | wt |
| MsC093 | −11 bp | −10 bp c | −6 bp | wt |
| MsC094 | −11 bp | −10 bp c | wt | −10 bp b |
| MsC095 | wt | −16 bp | −6 bp | wt |
| MsC096 | wt | −10 bp c | −6 bp | −10 bp b |
| MsC097 | −11 bp | −16 bp | −6 bp | wt |
| MsC098 | −11 bp | −16 bp | wt | −10 bp b |
| MsC099 | −11 bp | −10 bp c | −6 bp | −10 bp b |
| MsC100 | −12 bp | −10 bp c | wt | wt |
| MsC101 | wt | −30 bp | wt | wt |
| MsC102 | wt | −10 bp c | −20 bp | wt |
| MsC103 | −12 bp | −30 bp | wt | wt |
| MsC104 | −12 bp | −10 bp c | −20 bp | wt |
| MsC105 | −12 bp | −10 bp c | wt | −57 bp |
| MsC106 | wt | −30 bp | −20 bp | wt |

TABLE 4-continued

Alfalfa lines with mutations in COMT alleles
"−10 bp a" refers to the 10 bp deletion originating from plant Ms491-1
"−10 bp b" refers to the 10 bp deletion originating from plant Ms491-2
"−10 bp c" refers to the 10 bp deletion originating from plant Ms553-1

| Plant | Allele 1 | Allele 2 | Allele 3 | Allele 4 |
|---|---|---|---|---|
| MsC107 | wt | −30 bp | wt | −57 bp |
| MsC108 | wt | −10 bp c | −20 bp | −57 bp |
| MsC109 | −12 bp | −30 bp | −20 bp | wt |
| MsC110 | −12 bp | −30 bp | wt | −57 bp |
| MsC111 | −12 bp | −10 bp c | −20 bp | −57 bp |
| MsC112 | −5 bp | −5 bp | −10 bp a | −10 bp a |
| MsC113 | −5 bp | −5 bp | −13 bp | −13 bp |
| MsC114 | −5 bp | −5 bp | −10 bp b | −10 bp b |
| MsC115 | −5 bp | −5 bp | −20 bp | −20 bp |
| MsC116 | −5 bp | −5 bp | −57 bp | −57 bp |
| MsC117 | −11 bp | −11 bp | −10 bp a | −10 bp a |
| MsC118 | −11 bp | −11 bp | −13 bp | −13 bp |
| MsC119 | −11 bp | −11 bp | −10 bp b | −10 bp b |
| MsC120 | −11 bp | −11 bp | −20 bp | −20 bp |
| MsC121 | −11 bp | −11 bp | −57 bp | −57 bp |
| MsC122 | −16 bp | −16 bp | −10 bp a | −10 bp a |
| MsC123 | −16 bp | −16 bp | −13 bp | −13 bp |
| MsC124 | −16 bp | −16 bp | −10 bp b | −10 bp b |
| MsC125 | −16 bp | −16 bp | −20 bp | −20 bp |
| MsC126 | −16 bp | −16 bp | −57 bp | −57 bp |
| MsC127 | −10 bp c | −10 bp c | −10 bp a | −10 bp a |
| MsC128 | −10 bp c | −10 bp c | −13 bp | −13 bp |
| MsC129 | −10 bp c | −10 bp c | −10 bp b | −10 bp b |
| MsC130 | −10 bp c | −10 bp c | −20 bp | −20 bp |
| MsC131 | −10 bp c | −10 bp c | −57 bp | −57 bp |

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (32541 sequences)

SEQ ID NO: 1 - DNA, 1098 bp, Medicago sativa
  COMT coding sequence
atgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttacggtttggctactgttgctaagtatttggttaagaatgaagatggtgtttctatttctgctcttaatctcatgaatcaggataaagtgctcatggaaagctggtaccacctaaaagatgcagtccttgatgggggcattccattcaacaaggcttatggaatgacagcctttgaataccatggaacagatccaaggtttaacaaggttttcaacaaggggatgtctgatcactctaccatcacaatgaagaaaattcttgagacctacacaggttttgaaggccttaaatctcttgttgatgtaggtggtggtaccggagctgtaattaacacgattgtctcaaaatatcccactattaagggtattaattttgatttaccccatgtcattgaagatgctccatcttatccaggagttgagcatgttggtggagacatgtttgtcagtattccaaaggctgatgctgtttttatgaagtggatttgtcatgactggagtgatgagcactgcttgaaatttttgaagaactgctatgaggcactgccagacaatggaaaagtgattgtggcagaatgcatacttccagtggctccagattcaagcctggccacaaaaggtgtggttcacattgatgtgatcatgttggctcataatccaggtgggaaagagagaacacaaaaagagtttgaggatcttgccaaaggtgctggattccaaggtttcaaagtccattgtaatgctttcaacacatacatcatggagtttcttaagaaggtttaa

SEQ ID NO: 2 - DNA, 22 bp, Medicago sativa
  MsCOMT forward primer
cctcatcaatcacaaccatggg

SEQ ID NO: 3 - DNA, 20 bp, Medicago sativa
  MsCOMT reverse primer
agcaacagtagccaaaccat

SEQ ID NO: 4 - DNA, 20 bp, Medicago sativa
  MsCOMT forward primer
gtggtggtactggagctgta

SEQ ID NO: 5 - DNA, 20 bp, Medicago sativa
  MsCOMT reverse primer
actcagatgcaacacaccaa

SEQ ID NO: 6 - DNA, 54 bp, Medicago sativa
  MsCOMT_T01.1 target sequence
ttcaacaggtgaaactcaaataacaccaacccacatatcagatgaagaagcaaa

SEQ ID NO: 7 - DNA, 56 bp, Medicago sativa
  MsCOMT_T02.1 target sequence
ttgaacttgatctcttagaaatcattgctaaagctggacctggtgctcaaatttca

SEQ ID NO: 8 - DNA, 57 bp, Medicago sativa
  MsCOMT_T03.1 target sequence
tattgaaattgcttctcagctaccaacaactaaccctgatgcaccagttatgttgga

SEQ ID NO: 9 - DNA, 325 bp, Medicago sativa
  MsCOMT partial sequence, Allele 1
atgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgg

SEQ ID NO: 10 - DNA, 327 bp, Medicago sativa
  MsCOMT partial sequence, Allele 2
atgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggct

SEQ ID NO: 11 - DNA, 332 bp, Medicago sativa
  MsCOMT partial sequence, Allele 3
atgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgt

SEQ ID NO: 12 - DNA, 325 bp, Medicago sativa
  MsCOMT partial sequence, Allele 4
atgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgg

SEQ ID NO: 13 - DNA, 327 bp, Medicago sativa
  MsCOMT partial sequence, Allele 5
atgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggct

SEQ ID NO: 14 - DNA, 325 bp, Medicago sativa
  MsCOMT partial sequence, Allele 6
atgggttcaacaggtgaaactcaaataacaccaacccacatatcagatgaagaagcaaacctcttcgccatgcaactagcaagtgcttcagttcttcccatgattttgaaatcagctcttgaacttgatctattagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgg

SEQ ID NO: 15 - DNA, 323 bp, Medicago sativa
  MsCOMT partial sequence, Allele 7
atgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggttt

SEQ ID NO: 16 - DNA, 360 bp, Artificial
  MsCOMT deletion introduced by TALEN pair MsCOMT_T01.1
tttcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 17 - DNA, 357 bp, Artificial
  MsCOMT deletion introduced by TALEN pair MsCOMT_T01.1
tttcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 18 - DNA, 309 bp, Artificial
  MsCOMT deletion introduced by TALEN pair MsCOMT_T01.1
ttccaaaaacctctcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 19 - DNA, 356 bp, Artificial
  MsCOMT deletion introduced by TALEN pair MsCOMT_T01.1
ttccaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 20 - DNA, 358 bp, Artificial
  MsCOMT deletion introduced by TALEN pair MsCOMT_T01.1
ttcacaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 21 - DNA, 362 bp, Artificial
  MsCOMT deletion introduced by TALEN pair MsCOMT_T01.1
ttcacaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 22 - DNA, 359 bp, Artificial
  MsCOMT deletion introduced by TALEN pair MsCOMT_T01.1
ttcacaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 23 - DNA, 356 bp, Artificial
  MsCOMT deletion introduced by TALEN pair MsCOMT_T01.1
ttcacaaaaacctctcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 24 - DNA, 356 bp, Artificial
  MsCOMT deletion introduced by TALEN pair MsCOMT_T01.1
ttcacaaaaacctcctcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcatcagatatgttggaccgaatgttgcgtctcttggcttgttacaatatcctcacttgttcagttcgtactcaacaagatggaaaagttcagagactttatggtttggctactgttgctaa

SEQ ID NO: 25 - DNA, 356 bp, Artificial
  MsCOMT deletion introduced by TALEN pair MsCOMT_T01.1
ttcacaaaaacctcctcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26 - DNA, 359 bp, Artificial
  MsCOMT deletion introduced by TALEN pair MsCOMT_T01.1
ttcacaaaaacctcctcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27 - DNA, 360 bp, Artificial
  MsCOMT deletion introduced by TALEN pair MsCOMT_T01.1
ttcacaaaaacctcctcaatcacaaccatgggttcaacaggagaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcgacaagatggaaagattcagagactttatggtttggctactgttgctaa

SEQ ID NO: 28 - DNA, 356 bp, Artificial
  MsCOMT deletion introduced by TALEN pair MsCOMT_T01.1
ttcacaaaaacctcatcagtcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29 - DNA, 351 bp, Artificial
  MsCOMT deletion introduced by TALEN pair MsCOMT_T01.1
ttcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30 - DNA, 348 bp, Artificial
  MsCOMT deletion introduced by TALEN pair MsCOMT_T01.1
ttcacaaaaacctcatcaatcacaaccatgggttcaacaggtgaaactcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31 - DNA, 348 bp, Artificial
  MsCOMT deletion introduced by TALEN pair MsCOMT_T01.1
ttcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32 - DNA, 354 bp, Artificial
  MsCOMT deletion introduced by TALEN pair MsCOMT_T01.1
ttcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 33 - DNA, 354 bp, Artificial
  MsCOMT deletion introduced by TALEN pair MsCOMT_T01.1
ttcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcaatgctaaagctggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatggaaagattcagagactttatggtttggctatgttgctaa

SEQ ID NO: 34 - DNA, 355 bp, Artificial
  MsCOMT deletion introduced by TALEN pair MsCOMT_T01.1
ttcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 35 - DNA, 355 bp, Artificial
  MsCOMT deletion introduced by TALEN pair MsCOMT_T01.1
ttcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 36 - DNA, 353 bp, Artificial
  MsCOMT deletion introduced by TALEN pair MsCOMT_T01.1
ttcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 37 - DNA, 361 bp, Artificial
  MsCOMT deletion introduced by TALEN pair MsCOMT_T01.1
ttcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 38 - DNA, 359 bp, Artificial
  MsCOMT deletion introduced by TALEN pair MsCOMT_T01.1
ttcacaaaaacctcatcaatcacaaccatgggttcaacaggtgaaactcaaatcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 39 - DNA, 359 bp, Artificial
  MsCOMT deletion introduced by TALEN pair MsCOMT_T01.1
ttcacaaaaacctcatcaatcacaaccatgggttcaacaggtgaaactcaaatcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 40 - DNA, 363 bp, Artificial
  MsCOMT deletion introduced by TALEN pair MsCOMT_T01.1
ttcacaaaaacctcatcaatcacaaccatgggttcaacaggtgaaactcaaatcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 41 - DNA, 363 bp, Artificial
  MsCOMT deletion introduced by TALEN pair MsCOMT_T01.1
ttcacaaaaacctcatcaatcacaaccatgggttcaacaggtgaaactcaaatcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 42 - DNA, 360 bp, Artificial
  MsCOMT deletion introduced by TALEN pair MsCOMT_T01.1
ttcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 43 - DNA, 358 bp, Artificial
  MsCOMT deletion introduced by TALEN pair MsCOMT_T01.1
ttcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 44 - DNA, 358 bp, Artificial
  MsCOMT deletion introduced by TALEN pair MsCOMT_T01.1
ttcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 45 - DNA, 358 bp, Artificial
  MsCOMT deletion introduced by TALEN pair MsCOMT_T01.1
ttcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 46 - DNA, 358 bp, Artificial
  MsCOMT deletion introduced by TALEN pair MsCOMT_T01.1
ttcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 47 - DNA, 362 bp, Artificial
  MsCOMT deletion introduced by TALEN pair MsCOMT_T01.1
ttcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 48 - DNA, 354 bp, Artificial
  MsCOMT deletion introduced by TALEN pair MsCOMT_T01.1
ttcacaaaaacctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 49 - DNA, 359 bp, Artificial
  MsCOMT deletion introduced by TALEN pair MsCOMT_T01.1
ttcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 50 - DNA, 359 bp, Artificial
  MsCOMT deletion introduced by TALEN pair MsCOMT_T01.1
ttcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 51 - DNA, 359 bp, Artificial
  MsCOMT deletion introduced by TALEN pair MsCOMT_T01.1
ttcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 52 - DNA, 359 bp, Artificial
  MsCOMT deletion introduced by TALEN pair MsCOMT_T01.1
ttcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 53 - DNA, 359 bp, Artificial
  MsCOMT deletion introduced by TALEN pair MsCOMT_T01.1
ttcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 54 - DNA, 359 bp, Artificial
  MsCOMT deletion introduced by TALEN pair MsCOMT_T01.1
ttcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 55 - DNA, 359 bp, Artificial
  MsCOMT deletion introduced by TALEN pair MsCOMT_T01.1
ttcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 56 - DNA, 359 bp, Artificial
  MsCOMT deletion introduced by TALEN pair MsCOMT_T01.1
ttcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 57 - DNA, 359 bp, Artificial
  MsCOMT deletion introduced by TALEN pair MsCOMT_T01.1
ttcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 58 - DNA, 363 bp, Artificial
  MsCOMT deletion introduced by TALEN pair MsCOMT_T01.1
ttcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 59 - DNA, 363 bp, Artificial
  MsCOMT deletion introduced by TALEN pair MsCOMT_T01.1
ttcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 60 - DNA, 363 bp, Artificial
  MsCOMT deletion introduced by TALEN pair MsCOMT_T01.1
ttcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 61 - DNA, 363 bp, Artificial
  MsCOMT deletion introduced by TALEN pair MsCOMT_T01.1
ttcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 62 - DNA, 363 bp, Artificial
  MsCOMT deletion introduced by TALEN pair MsCOMT_T01.1
ttcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 63 - DNA, 363 bp, Artificial
  MsCOMT deletion introduced by TALEN pair MsCOMT_T01.1
ttcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 64 - DNA, 363 bp, Artificial
  MsCOMT deletion introduced by TALEN pair MsCOMT_T01.1
ttcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 65 - DNA, 445 bp, Artificial
  MsCOMT deletion introduced by TALEN pair MsCOMT_T01.1
ttcacaaaaacctcatcaatcacaaccatgggttcaacaggtgaaactcaaataacagttggtgatgtggttcagcctggtccgctgggccttgtagttgcccttgaagtggccggacacgaacaggaacttgagcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 66 - DNA, 362 bp, Artificial
  MsCOMT deletion introduced by TALEN pair MsCOMT_T01.1
ttcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 67 - DNA, 360 bp, Artificial
  MsCOMT deletion introduced by TALEN pair MsCOMT_T01.1
ttcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 68 - DNA, 359 bp, Artificial
  MsCOMT deletion introduced by TALEN pair MsCOMT_T01.1
ttcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 69 - DNA, 358 bp, Artificial
  MsCOMT deletion introduced by TALEN pair MsCOMT_T01.1
ttcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacgtgctaa

SEQ ID NO: 70 - DNA, 360 bp, Artificial
  MsCOMT deletion introduced by TALEN pair MsCOMT_T01.1
ttcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 71 - DNA, 360 bp, Artificial
  MsCOMT deletion introduced by TALEN pair MsCOMT_T01.1
ttcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 72 - DNA, 361 bp, Artificial
  MsCOMT deletion introduced by TALEN pair MsCOMT_T01.1
ttcacaaaaacctcatcaatcacaaccatgggttcaacaggtgaaactcaaataaaacccacatatcagatgaagaagcaaacctcttcgccatgcaattagcaagtgcttctgttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 73 - DNA, 361 bp, Artificial
  MsCOMT deletion introduced by TALEN pair MsCOMT_T01.1
ttcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 74 - DNA, 361 bp, Artificial
  MsCOMT deletion introduced by TALEN pair MsCOMT_T01.1
ttcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 75 - DNA, 361 bp, Artificial
  MsCOMT deletion introduced by TALEN pair MsCOMT_T01.1
ttcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 76 - DNA, 361 bp, Artificial
  MsCOMT deletion introduced by TALEN pair MsCOMT_T01.1
ttcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 77 - DNA, 356 bp, Artificial
  MsCOMT deletion introduced by TALEN pair MsCOMT_T01.1
ttcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgctctgttcgtactcaacaagatggaaaggttcagagactttatggtttggctactgttgctaa

SEQ ID NO: 78 - DNA, 356 bp, Artificial
  MsCOMT deletion introduced by TALEN pair MsCOMT_T01.1
ttcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 79 - DNA, 356 bp, Artificial
  MsCOMT deletion introduced by TALEN pair MsCOMT_T01.1
ttcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 80 - DNA, 356 bp, Artificial
  MsCOMT deletion introduced by TALEN pair MsCOMT_T01.1
ttcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatcgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 81 - DNA, 356 bp, Artificial
  MsCOMT deletion introduced by TALEN pair MsCOMT_T01.1
ttcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 82 - DNA, 356 bp, Artificial
  MsCOMT deletion introduced by TALEN pair MsCOMT_T01.1
ttcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 83 - DNA, 357 bp, Artificial
  MsCOMT deletion introduced by TALEN pair MsCOMT_T01.1
ttcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 84 - DNA, 357 bp, Artificial
  MsCOMT deletion introduced by TALEN pair MsCOMT_T01.1
ttcacaaaaacctcatcaatcacaaccatgggttcaacaggtgaaactcaaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 85 - DNA, 358 bp, Artificial
  MsCOMT deletion introduced by TALEN pair MsCOMT_T01.1
ttcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 86 - DNA, 358 bp, Artificial
  MsCOMT deletion introduced by TALEN pair MsCOMT_T01.1
ttcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 87 - DNA, 331 bp, Artificial
  MsCOMT deletion introduced by TALEN pair MsCOMT_T01.1
ttcacaaaaacctcatcaatcacaaccatgggttcaacaggtgaaaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 88 - DNA, 351 bp, Artificial
  MsCOMT deletion introduced by TALEN pair MsCOMT_T01.1
ttcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 89 - DNA, 363 bp, Artificial
  MsCOMT deletion introduced by TALEN pair MsCOMT_T01.1
ttcacaaaaacctcatcaatcacaacaatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 90 - DNA, 356 bp, Artificial
  MsCOMT deletion introduced by TALEN pair MsCOMT_T01.1
ttcacaaaaacctatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggttctcaaattacacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 91 - DNA, 415 bp, Artificial
  MsCOMT deletion introduced by TALEN pair MsCOMT_T01.1
tggcacaaaaacctcatcaatcgggagcaggggttcaacgggtgaaactcaaataacaaactctccctggctagcggtacgggtattaattgcggtgcgctcactaaccaacccacatatcagatgaagaagcaaacctcttcgccatgcaattagcaagtgcttcagttcttcccatgattttgaaatcagctcttgaacttgatctcttagaaatcattggtaaagctggacctggtgctgaaatttctcctattgaaattgcttctcagctcccaacaactaaccctgatgcaccagttatgttggaccgaatttggcgtctcttggcttgttacaatatcctcacttgttcagttcgtactcaacaagatggaaagattcagagactttattgtttggctactggtgctaa

SEQ ID NO: 92 - DNA, 358 bp, Artificial
  MsCOMT deletion introduced by TALEN pair MsCOMT_T01.1
tcttcacaaaaacctcatcaatcacaaccatgggttcaacaggtgaaactcaaccccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 93 - DNA, 427 bp, Artificial
  MsCOMT deletion introduced by TALEN pair MsCOMT_T01.1
tcttacaaaaacctcatcaatcacaaccatgggttcaacaggtgaaactcaaatgcacgacgacatcattccgtggcgttatccagctaagcgcgaactgcaatttggagaatggcagcgcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 94 - DNA, 361 bp, Artificial
  MsCOMT deletion introduced by TALEN pair MsCOMT_T01.1
tcttacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 95 - DNA, 359 bp, Artificial
  MsCOMT deletion introduced by TALEN pair MsCOMT_T01.1
tcttacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 96 - DNA, 360 bp, Artificial
  MsCOMT deletion introduced by TALEN pair MsCOMT_T01.1
tcttacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 97 - DNA, 360 bp, Artificial
  MsCOMT deletion introduced by TALEN pair MsCOMT_T01.1
tcttacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 98 - DNA, 361 bp, Artificial
  MsCOMT deletion introduced by TALEN pair MsCOMT_T01.1
tcttacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 99 - DNA, 362 bp, Artificial
  MsCOMT deletion introduced by TALEN pair MsCOMT_T01.1
tcttacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaaggttcagagactttatggtttggctactgttgctaa

SEQ ID NO: 100 - DNA, 362 bp, Artificial
  MsCOMT deletion introduced by TALEN pair MsCOMT_T01.1
tcttacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 101 - DNA, 360 bp, Artificial
  MsCOMT deletion introduced by TALEN pair MsCOMT_T01.1
tcttacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 102 - DNA, 355 bp, Artificial
  MsCOMT deletion introduced by TALEN pair MsCOMT_T01.1
tcttacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 103 - DNA, 344 bp, Artificial
  MsCOMT deletion introduced by TALEN pair MsCOMT_T01.1
tcttacaaaaacctcatcaatcacaaccatgggttcaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 104 - DNA, 359 bp, Artificial
  MsCOMT deletion introduced by TALEN pair MsCOMT_T01.1
tctgacaaaaacctcatcaatcacaaccatgggttcaacaggtgaaactcaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 105 - DNA, 359 bp, Artificial
  MsCOMT deletion introduced by TALEN pair MsCOMT_T01.1
tctctcaaaaacctcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 106 - DNA, 356 bp, Artificial
  MsCOMT deletion introduced by TALEN pair MsCOMT_T01.1
tctctcaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 107 - DNA, 358 bp, Artificial
  MsCOMT deletion introduced by TALEN pair MsCOMT_T01.1
tctctcaaaaacctcatcaatcacaaccatgggttcaacaggtgaaactcaaatcccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 108 - DNA, 359 bp, Artificial
  MsCOMT deletion introduced by TALEN pair MsCOMT_T01.1
tctctcaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 109 - DNA, 360 bp, Artificial
  MsCOMT deletion introduced by TALEN pair MsCOMT_T01.1
tctctcaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 110 - DNA, 364 bp, Artificial
  MsCOMT deletion introduced by TALEN pair MsCOMT_T01.1
tctctcaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 111 - DNA, 357 bp, Artificial
  MsCOMT deletion introduced by TALEN pair MsCOMT_T01.1
tctctcaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 112 - DNA, 364 bp, Artificial
  MsCOMT deletion introduced by TALEN pair MsCOMT_T01.1
tctcgcaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 113 - DNA, 351 bp, Artificial
  MsCOMT deletion introduced by TALEN pair MsCOMT_T01.1
tctcctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttgtcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 114 - DNA, 360 bp, Artificial
  MsCOMT deletion introduced by TALEN pair MsCOMT_T01.1
tctcccccccccctcctccctcccaacccttttttcaacattttaaactcaaataacccacatatcagatgaagaatcaaacctcttctccattcaactatcaatttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 115 - DNA, 352 bp, Artificial
  MsCOMT deletion introduced by TALEN pair MsCOMT_T01.1
tctcccccccccctcctccctcacaaccatgggttcaacaggttgaaacccacctatcagatgaagaagcaaacctcttcgccatgcacttagcaagtgcttcagttcttcccatgattttaaaatcagctcttgaacttgatctcttagaaatcattgctaaagctggacctgttgctcaaatttcacctcttgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 116 - DNA, 360 bp, Artificial
  MsCOMT deletion introduced by TALEN pair MsCOMT_T01.1
tctcccccccccctcctccctcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaactttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 117 - DNA, 358 bp, Artificial
  MsCOMT deletion introduced by TALEN pair MsCOMT_T01.1
tctcccccccccctcctccctcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 118 - DNA, 360 bp, Artificial
  MsCOMT deletion introduced by TALEN pair MsCOMT_T01.1
tctcccccccccctcatccctcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 119 - DNA, 363 bp, Artificial
  MsCOMT deletion introduced by TALEN pair MsCOMT_T01.1
tctcccccccccctcatccctcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 120 - DNA, 363 bp, Artificial
  MsCOMT deletion introduced by TALEN pair MsCOMT_T01.1
tctccccccacctcatcaatcacaaccattttttcaacatttgaaactcaaatcaccaacccacatatcagatgaagaagcaaacctcttctccattcaattatcaatttcttcagttcttcccatgattttaaaatcagctctttaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 121 - DNA, 356 bp, Artificial
  MsCOMT deletion introduced by TALEN pair MsCOMT_T01.1
tctccccccaccctcatcaatcacaaccatgggttcaacaggtgaaactcaacccacatatcagatgaagaagcaaacctcttcgccctgcaattcgcccgtgcttccgttcttcccctgcttttcaaatcagctcttgcacttgatctcttcgccctccttgctcccgctggacctggtgctcacatttcccctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 122 - DNA, 362 bp, Artificial
  MsCOMT deletion introduced by TALEN pair MsCOMT_T01.1
tctccccccaccctcatcaatcacaaccatgggttcaacaggtgaaactcaaataaaacccacatatcagatgaagaagcaaacctcttcgcccttcccttcgcccgtgcttccgttcttcccatgattttaccatcagctcttgaactttatctcttcgccctccttgctaaagctggacctggtgctcaactttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 123 - DNA, 359 bp, Artificial
  MsCOMT deletion introduced by TALEN pair MsCOMT_T01.1
tctccccccaacctcatcaatcacaaccatgggttcaacaggtgaaactcaaatacccacatatcagatgaagaagcaaacctcttcgccatgcaactagcaagtgcttcatttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 124 - DNA, 359 bp, Artificial
  MsCOMT deletion introduced by TALEN pair MsCOMT_T01.1
tctcccccacccctcctccatcacaaccatgggttcaacaggtgaaactcaaatacccacatatcagatgaagaagcaaacctcttcgccatgcaattagcaagtgcttccgttcttcccatgattttaaaatcagctcttgaacttgatctcttagaaatcattgctaaagctggacctggtgctcaaatttcacctattgaaattgcttctcagctaccaacaactaaccctgatgcaccagttgtgttggaccgaatgttgcgtctcttggcttgttacaatatcctcacttgttcagttcgtactcaacaagatggaaagattcagagcctttatggtttggctactgttgctaa

SEQ ID NO: 125 - DNA, 355 bp, Artificial
  MsCOMT deletion introduced by TALEN pair MsCOMT_T01.1
tctcccccacccctcctccatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcccctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 126 - DNA, 349 bp, Artificial
  MsCOMT deletion introduced by TALEN pair MsCOMT_T01.1
tctcccccacccctcatcactcacaaacatgggttcaacaggtgacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 127 - DNA, 360 bp, Artificial
  MsCOMT deletion introduced by TALEN pair MsCOMT_T01.1
tctcccccaaacctcatcaatcacaaccatggtttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 128 - DNA, 360 bp, Artificial
  MsCOMT deletion introduced by TALEN pair MsCOMT_T01.1
tctccccaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 129 - DNA, 360 bp, Artificial
  MsCOMT deletion introduced by TALEN pair MsCOMT_T01.1
tctcccaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 130 - DNA, 359 bp, Artificial
  MsCOMT deletion introduced by TALEN pair MsCOMT_T01.1
tctcccaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 131 - DNA, 358 bp, Artificial
  MsCOMT deletion introduced by TALEN pair MsCOMT_T01.1
tctcccaaaaacctcatcaatcacaaccatgggttcaacaggtgaaactcaaaacccacatatcagatgaagaagcaaacctcttcgccatgcaattagcaagtgcttcatttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 132 - DNA, 358 bp, Artificial
  MsCOMT deletion introduced by TALEN pair MsCOMT_T01.1
tctcccaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 133 - DNA, 360 bp, Artificial
  MsCOMT deletion introduced by TALEN pair MsCOMT_T01.1
tctccacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 134 - DNA, 361 bp, Artificial
  MsCOMT deletion introduced by TALEN pair MsCOMT_T01.1
tctccacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 135 - DNA, 366 bp, Artificial
  MsCOMT deletion introduced by TALEN pair MsCOMT_T01.1
tctccacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 136 - DNA, 357 bp, Artificial
  MsCOMT deletion introduced by TALEN pair MsCOMT_T01.1
tctccaaacctcatcaatcacaaccatgggttcaacaggtgacactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 137 - DNA, 360 bp, Artificial
  MsCOMT deletion introduced by TALEN pair MsCOMT_T01.1
tctccaaaactcacaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcacttggcttgttacaatatcctcccttgttcagttcgtactcaacaagatggaaaggttcagagactttatggtttggctactgttgctaa

SEQ ID NO: 138 - DNA, 355 bp, Artificial
  MsCOMT deletion introduced by TALEN pair MsCOMT_T01.1
tctccaaaacctcatcaatcacaaccatgtgttcaacaggtgcaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 139 - DNA, 358 bp, Artificial
  MsCOMT deletion introduced by TALEN pair MsCOMT_T01.1
tctccaaaacctcatcaatcacaaccatgggttcaacaggtgcaactcaaataccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 140 - DNA, 358 bp, Artificial
  MsCOMT deletion introduced by TALEN pair MsCOMT_T01.1
tctccaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 141 - DNA, 357 bp, Artificial
  MsCOMT deletion introduced by TALEN pair MsCOMT_T01.1
tctccaaaaactcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 142 - DNA, 358 bp, Artificial
  MsCOMT deletion introduced by TALEN pair MsCOMT_T01.1
tctccaaaaactcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 143 - DNA, 360 bp, Artificial
  MsCOMT deletion introduced by TALEN pair MsCOMT_T01.1
tctccaaaaacctcctcaatcacaaccattggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 144 - DNA, 356 bp, Artificial
  MsCOMT deletion introduced by TALEN pair MsCOMT_T01.1
tctccaaaaacctcctcaatcacaaccattggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 145 - DNA, 362 bp, Artificial
  MsCOMT deletion introduced by TALEN pair MsCOMT_T01.1
tctccaaaaacctcctcaatcacaaccatgggttcaacaggtgaaactcaaatcacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 146 - DNA, 359 bp, Artificial
  MsCOMT deletion introduced by TALEN pair MsCOMT_T01.1
tctccaaaaacctcctcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 147 - DNA, 359 bp, Artificial
  MsCOMT deletion introduced by TALEN pair MsCOMT_T01.1
tctccaaaaacctcctcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgagtgttgcgtctcttggcttgttacaatatcctcacttgttcagttcgtactcaacaagatggaaaagttcagagactttagggtttggctactgttgcaaa

SEQ ID NO: 148 - DNA, 363 bp, Artificial
  MsCOMT deletion introduced by TALEN pair MsCOMT_T01.1
tctccaaaaacctcctcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 149 - DNA, 350 bp, Artificial
  MsCOMT deletion introduced by TALEN pair MsCOMT_T01.1
tctccaaaaacctcctcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 150 - DNA, 350 bp, Artificial
  MsCOMT deletion introduced by TALEN pair MsCOMT_T01.1
tctccaaaaacctcatcaatcacaaccattggttcaacaggtgaaacccacatatcagatgaagaagcaaacctcttcgccatgcaactagcaagtgcttcagttcttcccatgattttgaaatcagctcttgaacttgatctcttagaattcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 151 - DNA, 351 bp, Artificial
  MsCOMT deletion introduced by TALEN pair MsCOMT_T01.1
tctccaaaaacctcatcaatcacaaccatgggttcaacaggttgaaacccacatatcagatgaagaagcaaacctcttcgccatgcaattagcaagtgcttcagttcttcccatgattttaaaataagctcttgaacttgatctcttagaaatcattgctaaagctgcacctggtgctcaaatttcacctattgaaattgcttctcagctcccaacaactaaccctgatgcaccagttatgttgtaccgaattttgcgtctcttggcttgttacaatatcctcacttgttcagttcgtactcaacaagattgaaaggttcagagactttatggtttggctactgttgctaa

SEQ ID NO: 152 - DNA, 351 bp, Artificial
  MsCOMT deletion introduced by TALEN pair MsCOMT_T01.1
tctccaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 153 - DNA, 359 bp, Artificial
  MsCOMT deletion introduced by TALEN pair MsCOMT_T01.1
tctccaaaaacctcatcaatcacaaccatgggttcaacaggtgaaactccaatcacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 154 - DNA, 354 bp, Artificial
  MsCOMT deletion introduced by TALEN pair MsCOMT_T01.1
tctccaaaaacctcatcaatcacaaccatgggttcaacaggtgaaactccaacccatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 155 - DNA, 364 bp, Artificial
  MsCOMT deletion introduced by TALEN pair MsCOMT_T01.1
tctccaaaaacctcatcaatcacaaccatgggttcaacaggtgaaactcaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 156 - DNA, 364 bp, Artificial
  MsCOMT deletion introduced by TALEN pair MsCOMT_T01.1
tctccaaaaacctcatcaatcacaaccatgggttcaacaggtgaaactcaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 157 - DNA, 355 bp, Artificial
  MsCOMT deletion introduced by TALEN pair MsCOMT_T01.1
tctccaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 158 - DNA, 353 bp, Artificial
  MsCOMT deletion introduced by TALEN pair MsCOMT_T01.1
tctccaaaaacctcatcaatcacaaccatgggttcaacaggtgaaactcaacacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 159 - DNA, 360 bp, Artificial
  MsCOMT deletion introduced by TALEN pair MsCOMT_T01.1
tctccaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 160 - DNA, 361 bp, Artificial
  MsCOMT deletion introduced by TALEN pair MsCOMT_T01.1
tctccaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 161 - DNA, 353 bp, Artificial
  MsCOMT deletion introduced by TALEN pair MsCOMT_T01.1
tctccaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 162 - DNA, 353 bp, Artificial
  MsCOMT deletion introduced by TALEN pair MsCOMT_T01.1
tctccaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 163 - DNA, 359 bp, Artificial
  MsCOMT deletion introduced by TALEN pair MsCOMT_T01.1
tctccaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggagagattcagagactttatggtttggctactgttgctaa

SEQ ID NO: 164 - DNA, 359 bp, Artificial
  MsCOMT deletion introduced by TALEN pair MsCOMT_T01.1
tctccaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 165 - DNA, 359 bp, Artificial
  MsCOMT deletion introduced by TALEN pair MsCOMT_T01.1
tctccaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 166 - DNA, 359 bp, Artificial
  MsCOMT deletion introduced by TALEN pair MsCOMT_T01.1
tctccaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 167 - DNA, 359 bp, Artificial
  MsCOMT deletion introduced by TALEN pair MsCOMT_T01.1
tctccaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 168 - DNA, 358 bp, Artificial
  MsCOMT deletion introduced by TALEN pair MsCOMT_T01.1
tctccaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagctggaaaggttcagagactttatggtttggctactgttctaa

SEQ ID NO: 169 - DNA, 359 bp, Artificial
  MsCOMT deletion introduced by TALEN pair MsCOMT_T01.1
tctccaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 170 - DNA, 359 bp, Artificial
  MsCOMT deletion introduced by TALEN pair MsCOMT_T01.1
tctccaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgttgcaccagttatgttggaccgaatgttgcgtctcttggcttgttacaatatcctcacttgttcagttcgtactcaacaagatggaaaggttcagagactttagggtttggctactgttgctaa

SEQ ID NO: 171 - DNA, 363 bp, Artificial
  MsCOMT deletion introduced by TALEN pair MsCOMT_T01.1
tctccaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 172 - DNA, 363 bp, Artificial
  MsCOMT deletion introduced by TALEN pair MsCOMT_T01.1
tctccaaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttctgttggtccgaatgttgcttctattggcttggtacaatttaatcacttgttcagttcgtactcaagaagatggaaagtttctgatactttgtggtttggctactgttgcgaa

SEQ ID NO: 173 - DNA, 362 bp, Artificial
  MsCOMT deletion introduced by TALEN pair MsCOMT_T01.1
tctccaaaaacctcatcaatcacaaccatgggttcaacaggtgaaactcaaataacaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 174 - DNA, 362 bp, Artificial
  MsCOMT deletion introduced by TALEN pair MsCOMT_T01.1
tctccaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 175 - DNA, 360 bp, Artificial
  MsCOMT deletion introduced by TALEN pair MsCOMT_T01.1
tctccaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 176 - DNA, 360 bp, Artificial
  MsCOMT deletion introduced by TALEN pair MsCOMT_T01.1
tctccaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 177 - DNA, 360 bp, Artificial
  MsCOMT deletion introduced by TALEN pair MsCOMT_T01.1
tctccaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 178 - DNA, 360 bp, Artificial
  MsCOMT deletion introduced by TALEN pair MsCOMT_T01.1
tctccaaaaacctcatcaatcacaaccatgggttcaacaggtgaaactcaaataaacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 179 - DNA, 360 bp, Artificial
  MsCOMT deletion introduced by TALEN pair MsCOMT_T01.1
tctccaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 180 - DNA, 356 bp, Artificial
  MsCOMT deletion introduced by TALEN pair MsCOMT_T01.1
tctccaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 181 - DNA, 356 bp, Artificial
  MsCOMT deletion introduced by TALEN pair MsCOMT_T01.1
tctccaaaaacctcatcaatcacaaccatgggttcaacaggtgaaactcaaacccacatatcagatgaagaagcaaacctcttcgccatgcaattagcaagtacttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 182 - DNA, 356 bp, Artificial
  MsCOMT deletion introduced by TALEN pair MsCOMT_T01.1
tctccaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 183 - DNA, 356 bp, Artificial
  MsCOMT deletion introduced by TALEN pair MsCOMT_T01.1
tctccaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 184 - DNA, 360 bp, Artificial
  MsCOMT deletion introduced by TALEN pair MsCOMT_T01.1
tctccaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 185 - DNA, 359 bp, Artificial
  MsCOMT deletion introduced by TALEN pair MsCOMT_T01.1
tctccaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 186 - DNA, 359 bp, Artificial
  MsCOMT deletion introduced by TALEN pair MsCOMT_T01.1
tctccaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgcctcttggcttgttacaatatcctcacttgttctgttcgtactcaacaagatggaaaggttcagagactttatggtttggctactgttgctaa

SEQ ID NO: 187 - DNA, 357 bp, Artificial
  MsCOMT deletion introduced by TALEN pair MsCOMT_T01.1
tctccaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 188 - DNA, 350 bp, Artificial
  MsCOMT deletion introduced by TALEN pair MsCOMT_T01.1
tctccaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 189 - DNA, 351 bp, Artificial
  MsCOMT deletion introduced by TALEN pair MsCOMT_T01.1
tctccaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 190 - DNA, 351 bp, Artificial
  MsCOMT deletion introduced by TALEN pair MsCOMT_T01.1
tctccaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 191 - DNA, 352 bp, Artificial
  MsCOMT deletion introduced by TALEN pair MsCOMT_T01.1
tctccaaaaacctcatcaatcacaaccatgggttcaacaggtgaaaaacccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 192 - DNA, 362 bp, Artificial
  MsCOMT deletion introduced by TALEN pair MsCOMT_T01.1
tctccaaaaacctcatcaatcacaaccatgggttcaaaaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 193 - DNA, 333 bp, Artificial
  MsCOMT deletion introduced by TALEN pair MsCOMT_T01.1
tctccaaaaacctcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 194 - DNA, 356 bp, Artificial
  MsCOMT deletion introduced by TALEN pair MsCOMT_T01.1
tctccaaaaacctatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 195 - DNA, 359 bp, Artificial
  MsCOMT deletion introduced by TALEN pair MsCOMT_T01.1
tctcataaaaacctcatcaatcacaaccatgggttcaacaggtgaaactcaaatacccacatatcagatgaagaagcaaacctcttcgccatgcaattagcaagtgcttcagtccttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 196 - DNA, 360 bp, Artificial
  MsCOMT deletion introduced by TALEN pair MsCOMT_T01.1
tctcataaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggtcctggtgctcaaatttcacctattgaaattgcttctcagctcccaacaactaaccctgatgcaccagtcatgttggaccgaatgttgcgtctcttggcttgttacaatatcctcacttgtactgttcgtactcaacaagatggaaaggttcagagacttcatggtttggctactgttgctaa

SEQ ID NO: 197 - DNA, 362 bp, Artificial
  MsCOMT deletion introduced by TALEN pair MsCOMT_T01.1
tctcataaaaacctcatcaatcacaaccatgggttcaacaggtgaaactcaaataacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcgacaagatggaaaggttcagagactttatggtttggctactgttgctaa

SEQ ID NO: 198 - DNA, 361 bp, Artificial
  MsCOMT deletion introduced by TALEN pair MsCOMT_T01.1
tctcataaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 199 - DNA, 358 bp, Artificial
  MsCOMT deletion introduced by TALEN pair MsCOMT_T01.1
tctcataaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatctttgctaaagctggacctgttgctcacctttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 200 - DNA, 354 bp, Artificial
  MsCOMT deletion introduced by TALEN pair MsCOMT_T01.1
tctcataaaaacctcatcaatcacaaccatgggttcaacaggcgaaactcaaataatatcagatgaagaagcaaacctcatcgccatgcaattagcaagtgcttcagttcttccaatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 201 - DNA, 360 bp, Artificial
  MsCOMT deletion introduced by TALEN pair MsCOMT_T01.1
tctcactaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagctatgttggaccgaatgttgcgtctcttggcttgttacaatatcctcacttgttcagttcgtactcaacaagatggaaaggttcagagactttatggtttggctactgttgctaa

SEQ ID NO: 202 - DNA, 357 bp, Artificial
  MsCOMT deletion introduced by TALEN pair MsCOMT_T01.1
tctcactaaaacctcatcaatcacaaccatgggttcaacaggtgaaactcaaacccacatatcagatgaagaagcaaacctcttcgccatgcaactatcaagtgcttcagttcttcccatgatttttaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 203 - DNA, 356 bp, Artificial
  MsCOMT deletion introduced by TALEN pair MsCOMT_T01.1
tctcacgaaaacctcatcaatcacaaccatgggttcaacaggtgaaactcaacccacatatcatatgcagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgttctcaacaaaatggaaagattcagagactttatggtttggctactgttgctaa

SEQ ID NO: 204 - DNA, 356 bp, Artificial
  MsCOMT deletion introduced by TALEN pair MsCOMT_T01.1
tctcacgaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 205 - DNA, 360 bp, Artificial
  MsCOMT deletion introduced by TALEN pair MsCOMT_T01.1
tctcacgaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 206 - DNA, 363 bp, Artificial
  MsCOMT deletion introduced by TALEN pair MsCOMT_T01.1
tctcacgaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 207 - DNA, 360 bp, Artificial
  MsCOMT deletion introduced by TALEN pair MsCOMT_T01.1
tctcacgaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 208 - DNA, 359 bp, Artificial
  MsCOMT deletion introduced by TALEN pair MsCOMT_T01.1
tctcacgaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 209 - DNA, 364 bp, Artificial
  MsCOMT deletion introduced by TALEN pair MsCOMT_T01.1
tctcacgaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 210 - DNA, 365 bp, Artificial
  MsCOMT deletion introduced by TALEN pair MsCOMT_T01.1
tctcacgaaaacctcatcaatcacaaccatgggttcaacaggtgaaactcaaataacaccacccacatatcagatgaagaagcaaacctcttcgccatgcaattagcaagtgcttcagttcttcccatggttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 211 - DNA, 364 bp, Artificial
  MsCOMT deletion introduced by TALEN pair MsCOMT_T01.1
tctcacgaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagcaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 212 - DNA, 360 bp, Artificial
  MsCOMT deletion introduced by TALEN pair MsCOMT_T01.1
tctcacgaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 213 - DNA, 358 bp, Artificial
  MsCOMT deletion introduced by TALEN pair MsCOMT_T01.1
tctcacgaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 214 - DNA, 358 bp, Artificial
  MsCOMT deletion introduced by TALEN pair MsCOMT_T01.1
tctcacgaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 215 - DNA, 358 bp, Artificial
  MsCOMT deletion introduced by TALEN pair MsCOMT_T01.1
tctcacgaaaacctcatcaatcacaaccatgggttcaacaggtgaaactcaaaacccacatatcagatgaagaagcaaacctcttcgccatgcaattagcaagtgcttcaggtcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 216 - DNA, 359 bp, Artificial
  MsCOMT deletion introduced by TALEN pair MsCOMT_T01.1
tctcacgaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 217 - DNA, 358 bp, Artificial
  MsCOMT deletion introduced by TALEN pair MsCOMT_T01.1
tctcacgaaaacctcatcaatcacaaccatgggttcaacaggggaaactcaaaacccacatatcagatgaagaagcaaacctcttcgccatgcaattatcaagtgcttcagttcttcccatgattttgacatcagctcttgaacttgatctcttagaaatcattgctaaagctgcacctggtgctcaaatttcccctattgaaattgcttctcagctaccaacaactacccctgatgcaccagttatgttggaccgaatgttgcgacacttggctggtgacaatagcctcactggttcaggtcgtactcaacaagatggaaaggttcagagactttatggtggggctactggtgctaa

SEQ ID NO: 218 - DNA, 355 bp, Artificial
  MsCOMT deletion introduced by TALEN pair MsCOMT_T01.1
tctcaccctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 219 - DNA, 352 bp, Artificial
  MsCOMT deletion introduced by TALEN pair MsCOMT_T01.1
tctcaccatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 220 - DNA, 342 bp, Artificial
  MsCOMT deletion introduced by TALEN pair MsCOMT_T01.1
tctcaccaaaacctcatcaatcacaaccatgggttcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 221 - DNA, 350 bp, Artificial
  MsCOMT deletion introduced by TALEN pair MsCOMT_T01.1
tctcacatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 222 - DNA, 361 bp, Artificial
  MsCOMT deletion introduced by TALEN pair MsCOMT_T01.1
tctcacataaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 223 - DNA, 359 bp, Artificial
  MsCOMT deletion introduced by TALEN pair MsCOMT_T01.1
tctcacagaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 224 - DNA, 357 bp, Artificial
  MsCOMT deletion introduced by TALEN pair MsCOMT_T01.1
tctcacagaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgttgcaccagttatgttggaccgaatgttgcgtctcttggcttgttacaatatcctcacttgttcagttcgtactcaacaagatggaaaggttcagagactttatggtttggctactgttgctaa

SEQ ID NO: 225 - DNA, 358 bp, Artificial
  MsCOMT deletion introduced by TALEN pair MsCOMT_T01.1
tctcacagaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 226 - DNA, 350 bp, Artificial
  MsCOMT deletion introduced by TALEN pair MsCOMT_T01.1
tctcacactcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 227 - DNA, 360 bp, Artificial
  MsCOMT deletion introduced by TALEN pair MsCOMT_T01.1
tctcacacctcatcaatcacaaccatgggttcaacaggtgaacctcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 228 - DNA, 355 bp, Artificial
  MsCOMT deletion introduced by TALEN pair MsCOMT_T01.1
tctcacacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 229 - DNA, 360 bp, Artificial
  MsCOMT deletion introduced by TALEN pair MsCOMT_T01.1
tctcacacctcatcaatcacaaccatgggttcaacaggtgaaactcaaataaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 230 - DNA, 358 bp, Artificial
  MsCOMT deletion introduced by TALEN pair MsCOMT_T01.1
tctcacacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 231 - DNA, 360 bp, Artificial
  MsCOMT deletion introduced by TALEN pair MsCOMT_T01.1
tctcacacaaatctcatcaatcacaaccatgggttcaacaggtgaaactcaaccaacccacatatcagatgaagaagcaaacctgttcgccatgcaattagcaagtgcttcagttcttcccatgagtttaaaagcagctcttgaacttgatctcttaaaaatcattgctaacgctggacctggtgctcgaatttctcctgttcaaattgcttctcagcttccaatgactaaccctgatgcaccagtcatgttggaccgaatgttgcgtctcttggcttgttacaatatcctcacttgttctgttcgtactaagcaagatggaaagattcagagactttattggctggatactgatgctaa

SEQ ID NO: 232 - DNA, 350 bp, Artificial
  MsCOMT deletion introduced by TALEN pair MsCOMT_T01.1
tctcacaatcaatcacaaccattggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 233 - DNA, 351 bp, Artificial
  MsCOMT deletion introduced by TALEN pair MsCOMT_T01.1
tctcacaataacctcatcaatcacaaccatgggttcaacaggtgaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 234 - DNA, 360 bp, Artificial
  MsCOMT deletion introduced by TALEN pair MsCOMT_T01.1
tctcacaagaacctcatcaatcacaaccatgggttcaacaggtgaaactctaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 235 - DNA, 358 bp, Artificial
  MsCOMT deletion introduced by TALEN pair MsCOMT_T01.1
tctcacaagaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 236 - DNA, 358 bp, Artificial
  MsCOMT deletion introduced by TALEN pair MsCOMT_T01.1
tctcacaagaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 237 - DNA, 355 bp, Artificial
  MsCOMT deletion introduced by TALEN pair MsCOMT_T01.1
tctcacaactcatcaatcacaaccatgggttcaacaggtgaaactcacccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaagattcagagactttatggtttggctactgttgctaa

SEQ ID NO: 238 - DNA, 347 bp, Artificial
  MsCOMT deletion introduced by TALEN pair MsCOMT_T01.1
tctcacaacctcatcaatcacaaccatgggttcaacaggtgacactcaatatcagatgaagaagcaaacctcttcgccatgccactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 239 - DNA, 357 bp, Artificial
  MsCOMT deletion introduced by TALEN pair MsCOMT_T01.1
tctcacaacctcatcaatcacaaccatgggttcaacaggtgacactcaaataacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctgttcaaattgcttctcagcttccaacaactatccctgatgcaccagttatgttggaccgaatgttgcgtcgcttggcttgttacaatatccgcacttgttcagttcgtactcaacaagatggaaaggttcagagcctttatggtttggcaactgttgctaa

SEQ ID NO: 240 - DNA, 357 bp, Artificial
  MsCOMT deletion introduced by TALEN pair MsCOMT_T01.1
tctcacaacctcatcaatcacaaccatgggttcaacaggtgaaactcaaataacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 241 - DNA, 357 bp, Artificial
  MsCOMT deletion introduced by TALEN pair MsCOMT_T01.1
tctcacaacctcatcaatcacaaccatgggttcaacaggtgaaactcaaagaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgattattgcgtcccttggcttgttacaatatcctcatttgttcagttcgtaaccaacaagatggaaaggttcagagactgtatggtttggctactgttgctaa

SEQ ID NO: 242 - DNA, 354 bp, Artificial
  MsCOMT deletion introduced by TALEN pair MsCOMT_T01.1
tctcacaacatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 243 - DNA, 357 bp, Artificial
  MsCOMT deletion introduced by TALEN pair MsCOMT_T01.1
tctcacaaatacctcatcaatcacaaccatgggttcaacaggtgagactcaaacccacatatcagatgaagaagcaaacctcttcaccatgcaactagcaagtgcttcagttcttcccatgattttaaaatcagctcttgaacttgatctcttagaaatcattgctaaagctggacctggtgttcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 244 - DNA, 359 bp, Artificial
  MsCOMT deletion introduced by TALEN pair MsCOMT_T01.1
tctcacaaatacctcatcaatcacaaccatgggttcaacaggtgaaactcaaatacacacatatcagatgaagaagcaaacctcttcgccatgcaactagcaagtgcttcagttcttcccatgattttgaactcagctcttgaacttgatctcttagaaatcattgctaaagcttgacctggtgttcaaatttcacctattgaaattggttctcagctaccaacaactaaccctgatgcaccagttatgttggaccgaattttgcgtctcttggcttgttacaatatcctcacttgttcagttagtactcaacaagatagaaaggtgcagagactttatggtttggctactgttgctaa

SEQ ID NO: 245 - DNA, 361 bp, Artificial
  MsCOMT deletion introduced by TALEN pair MsCOMT_T01.1
tctcacaaatacctcatcaatcacaaccatgggttcaacaggtgaaactcaaataaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 246 - DNA, 359 bp, Artificial
  MsCOMT deletion introduced by TALEN pair MsCOMT_T01.1
tctcacaaagtcctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 247 - DNA, 361 bp, Artificial
  MsCOMT deletion introduced by TALEN pair MsCOMT_T01.1
tctcacaaagacctcatcaatcacaaccatgggttcaacaggtgaaactcaaattaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaagcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 248 - DNA, 360 bp, Artificial
  MsCOMT deletion introduced by TALEN pair MsCOMT_T01.1
tctcacaaagacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 249 - DNA, 361 bp, Artificial
  MsCOMT deletion introduced by TALEN pair MsCOMT_T01.1
tctcacaaagacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 250 - DNA, 348 bp, Artificial
  MsCOMT deletion introduced by TALEN pair MsCOMT_T01.1
tctcacaaagacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 251 - DNA, 360 bp, Artificial
  MsCOMT deletion introduced by TALEN pair MsCOMT_T01.1
tctcacaaactcatcaatcacaaccatgggttcaacaggtgacactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 252 - DNA, 357 bp, Artificial
  MsCOMT deletion introduced by TALEN pair MsCOMT_T01.1
tctcacaaactcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 253 - DNA, 361 bp, Artificial
  MsCOMT deletion introduced by TALEN pair MsCOMT_T01.1
tctcacaaactcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 254 - DNA, 347 bp, Artificial
  MsCOMT deletion introduced by TALEN pair MsCOMT_T01.1
tctcacaaacctcatcaatcacaaccatgggttcaacaggtgcaactcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattggttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcgaa

SEQ ID NO: 255 - DNA, 359 bp, Artificial
  MsCOMT deletion introduced by TALEN pair MsCOMT_T01.1
tctcacaaacctcatcaatcacaaccatgggttcaacaggtgcaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 256 - DNA, 354 bp, Artificial
  MsCOMT deletion introduced by TALEN pair MsCOMT_T01.1
tctcacaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaacctggacctggtcctcaaatttcacctattgaaattgcttctcagctcccaacaactaaccctgatgcaccagttatgttggaccgaatgttccgtctcttggcttgttacaatatcctcacttgttcagttcctactcaacaagattgaaaggttcagagactttatggtttggctactgttcctaa

SEQ ID NO: 257 - DNA, 357 bp, Artificial
  MsCOMT deletion introduced by TALEN pair MsCOMT_T01.1
tctcacaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 258 - DNA, 360 bp, Artificial
  MsCOMT deletion introduced by TALEN pair MsCOMT_T01.1
tctcacaaacctcatcaatcacaaccatgggttcaacaggtgaaactcaaatccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 259 - DNA, 358 bp, Artificial
  MsCOMT deletion introduced by TALEN pair MsCOMT_T01.1
tctcacaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 260 - DNA, 358 bp, Artificial
  MsCOMT deletion introduced by TALEN pair MsCOMT_T01.1
tctcacaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 261 - DNA, 358 bp, Artificial
  MsCOMT deletion introduced by TALEN pair MsCOMT_T01.1
tctcacaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 262 - DNA, 358 bp, Artificial
  MsCOMT deletion introduced by TALEN pair MsCOMT_T01.1
tctcacaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 263 - DNA, 362 bp, Artificial
  MsCOMT deletion introduced by TALEN pair MsCOMT_T01.1
tctcacaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 264 - DNA, 361 bp, Artificial
  MsCOMT deletion introduced by TALEN pair MsCOMT_T01.1
tctcacaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 265 - DNA, 348 bp, Artificial
  MsCOMT deletion introduced by TALEN pair MsCOMT_T01.1
tctcacaaacctcataatcacaaccatgggttcaacaggtgaaactcaaatatcagatgaagaggcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 266 - DNA, 357 bp, Artificial
  MsCOMT deletion introduced by TALEN pair MsCOMT_T01.1
tctcacaaacctatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 267 - DNA, 356 bp, Artificial
  MsCOMT deletion introduced by TALEN pair MsCOMT_T01.1
tctcacaaacatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 268 - DNA, 358 bp, Artificial
  MsCOMT deletion introduced by TALEN pair MsCOMT_T01.1
tctcacaaacacctcctcaatcacaaccatgggttcaacaggtgaaactcaaatcccacatatcagatgaagaagcaaacctcttcgccatgcaattagtaagtgcttcagttcttccaatgattttaaaatcagctcttgaacttgatctcttagaagtcattgctaaagctggagctggtcctcaaatttcacctgttcaaattgcttcgcagcttccaacaactaaccctgatgcaccagtcatgttggaccgaatgttgcgtctctgggcttgttacaatatcctcacttgagcagttcgtactcaacaagatggaaagattcagagactttattgtttggctactgttgctaa

SEQ ID NO: 269 - DNA, 360 bp, Artificial
  MsCOMT deletion introduced by TALEN pair MsCOMT_T01.1
tctcacaaacacctcatcaatcacaaccatgggttcaacaggtgaaactcaaataacccacatatcagataaagaagcaaacctcttctccatgcaactagcaagttcttcagttcttcccatgattttgaaatcagctctcgaacttgatctcttagaaatcattgctaaagctggacctggtgctcaaatttcacctattgaaattgcttctcagctaccaacaactaaccctgatgcaccagttatgttggaccgaatgttgcgtctattggcttgttacaatatactcacgtgttcagttcgtactcaacaagatggaaaggttcagagactttatggtttggctactgttactaa

SEQ ID NO: 270 - DNA, 362 bp, Artificial
  MsCOMT deletion introduced by TALEN pair MsCOMT_T01.1
tctcacaaacacctcatcaatcacaaccatgggttcaacaggggaaactcaaatacaacccacatatcagatgaagaagcaaccctcttcgccatgcaactagcaagtgcttcagttcttcccatgattttgaaatcagctcttgaacttgatctcttaaaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagaaggaaaggttcagagactttatggtttggctactgttgctaa

SEQ ID NO: 271 - DNA, 360 bp, Artificial
  MsCOMT deletion introduced by TALEN pair MsCOMT_T01.1
tctcacaaaatcctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 272 - DNA, 357 bp, Artificial
  MsCOMT deletion introduced by TALEN pair MsCOMT_T01.1
tctcacaaaatcctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 273 - DNA, 357 bp, Artificial
  MsCOMT deletion introduced by TALEN pair MsCOMT_T01.1
tctcacaaaatcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 274 - DNA, 420 bp, Artificial
  MsCOMT deletion introduced by TALEN pair MsCOMT_T01.1
tctcacaaaagcctcatcaatcacaaccatgggttcaacaggtgaaactcaaatagccggtgctgtgccaggcccacggcttgaccccggagcaggtgttggccatcgccagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 275 - DNA, 355 bp, Artificial
  MsCOMT deletion introduced by TALEN pair MsCOMT_T01.1
tctcacaaaagcctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 276 - DNA, 363 bp, Artificial
  MsCOMT deletion introduced by TALEN pair MsCOMT_T01.1
tctcacaaaagcctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 277 - DNA, 361 bp, Artificial
  MsCOMT deletion introduced by TALEN pair MsCOMT_T01.1
tctcacaaaagcctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 278 - DNA, 361 bp, Artificial
  MsCOMT deletion introduced by TALEN pair MsCOMT_T01.1
tctcacaaaagcctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 279 - DNA, 361 bp, Artificial
  MsCOMT deletion introduced by TALEN pair MsCOMT_T01.1
tctcacaaaactcatcaatcacaaccatgggttcaacaggtgcaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 280 - DNA, 349 bp, Artificial
  MsCOMT deletion introduced by TALEN pair MsCOMT_T01.1
tctcacaaaactcatcaatcacaaccatgggttcaacaggtgaaactcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 281 - DNA, 358 bp, Artificial
  MsCOMT deletion introduced by TALEN pair MsCOMT_T01.1
tctcacaaaactcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 282 - DNA, 358 bp, Artificial
  MsCOMT deletion introduced by TALEN pair MsCOMT_T01.1
tctcacaaaacctctcaatcacaaccatgggttcaacaggtgcaactcaaataacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 283 - DNA, 360 bp, Artificial
  MsCOMT deletion introduced by TALEN pair MsCOMT_T01.1
tctcacaaaacctctcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 284 - DNA, 358 bp, Artificial
  MsCOMT deletion introduced by TALEN pair MsCOMT_T01.1
tctcacaaaacctcctcaatcacaaccattggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 285 - DNA, 359 bp, Artificial
  MsCOMT deletion introduced by TALEN pair MsCOMT_T01.1
tctcacaaaacctcctcaatcacaaccattggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 286 - DNA, 358 bp, Artificial
  MsCOMT deletion introduced by TALEN pair MsCOMT_T01.1
tctcacaaaacctcctcaatcacaaccattggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 287 - DNA, 356 bp, Artificial
  MsCOMT deletion introduced by TALEN pair MsCOMT_T01.1
tctcacaaaacctcctcaatcacaaccattggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 288 - DNA, 345 bp, Artificial
  MsCOMT deletion introduced by TALEN pair MsCOMT_T01.1
tctcacaaaacctcctcaatcacaaccatgggttcaaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 289 - DNA, 359 bp, Artificial
  MsCOMT deletion introduced by TALEN pair MsCOMT_T01.1
tctcacaaaacctcctcaatcacaaccatgggttcaacagttgaaactcaaataacccacatatcagatgaagaagcaaacctcttcgccatgcaactagcaagtgcttcatttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 290 - DNA, 358 bp, Artificial
  MsCOMT deletion introduced by TALEN pair MsCOMT_T01.1
tctcacaaaacctcctcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 291 - DNA, 358 bp, Artificial
  MsCOMT deletion introduced by TALEN pair MsCOMT_T01.1
tctcacaaaacctcctcaatcacaaccatgggttcaacaggtgaaactcaaatccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 292 - DNA, 350 bp, Artificial
  MsCOMT deletion introduced by TALEN pair MsCOMT_T01.1
tctcacaaaacctcctcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 293 - DNA, 359 bp, Artificial
  MsCOMT deletion introduced by TALEN pair MsCOMT_T01.1
tctcacaaaacctcctcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 294 - DNA, 359 bp, Artificial
  MsCOMT deletion introduced by TALEN pair MsCOMT_T01.1
tctcacaaaacctcctcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 295 - DNA, 362 bp, Artificial
  MsCOMT deletion introduced by TALEN pair MsCOMT_T01.1
tctcacaaaacctcctcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 296 - DNA, 360 bp, Artificial
  MsCOMT deletion introduced by TALEN pair MsCOMT_T01.1
tctcacaaaacctcctcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 297 - DNA, 360 bp, Artificial
  MsCOMT deletion introduced by TALEN pair MsCOMT_T01.1
tctcacaaaacctcctcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 298 - DNA, 361 bp, Artificial
  MsCOMT deletion introduced by TALEN pair MsCOMT_T01.1
tctcacaaaacctcctcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 299 - DNA, 356 bp, Artificial
  MsCOMT deletion introduced by TALEN pair MsCOMT_T01.1
tctcacaaaacctcctcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 300 - DNA, 356 bp, Artificial
  MsCOMT deletion introduced by TALEN pair MsCOMT_T01.1
tctcacaaaacctcctcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgatggaccgaatgttgcgtctcttggcttgttacaatatcctcacttgttcagttcgtactcaacaagatggaaaggttcagagactttatggtttggctactgttgctaa

SEQ ID NO: 301 - DNA, 357 bp, Artificial
  MsCOMT deletion introduced by TALEN pair MsCOMT_T01.1
tctcacaaaacctcctcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 302 - DNA, 358 bp, Artificial
  MsCOMT deletion introduced by TALEN pair MsCOMT_T01.1
tctcacaaaacctcctcaatcacaaccatgggtcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 303 - DNA, 358 bp, Artificial
  MsCOMT deletion introduced by TALEN pair MsCOMT_T01.1
tctcacaaaacctcatcatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 304 - DNA, 357 bp, Artificial
  MsCOMT deletion introduced by TALEN pair MsCOMT_T01.1
tctcacaaaacctcatcaatcacagccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 305 - DNA, 358 bp, Artificial
  MsCOMT deletion introduced by TALEN pair MsCOMT_T01.1
tctcacaaaacctcatcaatcacaaccattggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 306 - DNA, 359 bp, Artificial
  MsCOMT deletion introduced by TALEN pair MsCOMT_T01.1
tctcacaaaacctcatcaatcacaaccattggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 307 - DNA, 362 bp, Artificial
  MsCOMT deletion introduced by TALEN pair MsCOMT_T01.1
tctcacaaaacctcatcaatcacaaccattggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtagctaa

SEQ ID NO: 308 - DNA, 356 bp, Artificial
  MsCOMT deletion introduced by TALEN pair MsCOMT_T01.1
tctcacaaaacctcatcaatcacaaccattggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 309 - DNA, 352 bp, Artificial
  MsCOMT deletion introduced by TALEN pair MsCOMT_T01.1
tctcacaaaacctcatcaatcacaaccattggttcaacaggtgaaactcaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 310 - DNA, 361 bp, Artificial
  MsCOMT deletion introduced by TALEN pair MsCOMT_T01.1
tctcacaaaacctcatcaatcacaaccatgtgttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 311 - DNA, 362 bp, Artificial
  MsCOMT deletion introduced by TALEN pair MsCOMT_T01.1
tctcacaaaacctcatcaatcacaaccatgggttcgacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggttctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 312 - DNA, 357 bp, Artificial
  MsCOMT deletion introduced by TALEN pair MsCOMT_T01.1
tctcacaaaacctcatcaatcacaaccatgggttcatcaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 313 - DNA, 336 bp, Artificial
  MsCOMT deletion introduced by TALEN pair MsCOMT_T01.1
tctcacaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 314 - DNA, 345 bp, Artificial
  MsCOMT deletion introduced by TALEN pair MsCOMT_T01.1
tctcacaaaacctcatcaatcacaaccatgggttcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 315 - DNA, 351 bp, Artificial
  MsCOMT deletion introduced by TALEN pair MsCOMT_T01.1
tctcacaaaacctcatcaatcacaaccatgggttcaacaggttgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 316 - DNA, 350 bp, Artificial
  MsCOMT deletion introduced by TALEN pair MsCOMT_T01.1
tctcacaaaacctcatcaatcacaaccatgggttcaacaggtgagacccccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 317 - DNA, 332 bp, Artificial
  MsCOMT deletion introduced by TALEN pair MsCOMT_T01.1
tctcacaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 318 - DNA, 349 bp, Artificial
  MsCOMT deletion introduced by TALEN pair MsCOMT_T01.1
tctcacaaaacctcatcaatcacaaccatgggttcaacaggtgaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 319 - DNA, 349 bp, Artificial
  MsCOMT deletion introduced by TALEN pair MsCOMT_T01.1
tctcacaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 320 - DNA, 355 bp, Artificial
  MsCOMT deletion introduced by TALEN pair MsCOMT_T01.1
tctcacaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 321 - DNA, 353 bp, Artificial
  MsCOMT deletion introduced by TALEN pair MsCOMT_T01.1
tctcacaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 322 - DNA, 353 bp, Artificial
  MsCOMT deletion introduced by TALEN pair MsCOMT_T01.1
tctcacaaaacctcatcaatcacaaccatgggttcaacaggtgaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaatcctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 323 - DNA, 361 bp, Artificial
  MsCOMT deletion introduced by TALEN pair MsCOMT_T01.1
tctcacaaaacctcatcaatcacaaccatgggttcaacaggtgaaactctaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 324 - DNA, 359 bp, Artificial
  MsCOMT deletion introduced by TALEN pair MsCOMT_T01.1
tctcacaaaacctcatcaatcacaaccatgggttcaacaggtgaaactcgaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 325 - DNA, 353 bp, Artificial
  MsCOMT deletion introduced by TALEN pair MsCOMT_T01.1
tctcacaaaacctcatcaatcacaaccatgggttcaacaggtgaaactccacacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 326 - DNA, 433 bp, Artificial
  MsCOMT deletion introduced by TALEN pair MsCOMT_T01.1
tctcacaaaacctcatcaatcacaaccatgggttcaacaggtgaaactccaatggcacagcaccggcaacagccgctggaccgtctccagcgcctgcttgccaccgccattgctggcgatggccaccaacccacatatcagatgaagaagcaaacctcttcgccatgcaattcgcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 327 - DNA, 353 bp, Artificial
  MsCOMT deletion introduced by TALEN pair MsCOMT_T01.1
tctcacaaaacctcatcaatcacaaccatgggttcaacaggtgaaactccaataatatcagatgaagaagcaaacctcttcgccatgcaattagcaagtgcttcagttcttcccattattttaaaatcagctcttgaacttgatctcttaaaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 328 - DNA, 359 bp, Artificial
  MsCOMT deletion introduced by TALEN pair MsCOMT_T01.1
tctcacaaaacctcatcaatcacaaccatgggttcaacaggtgaaactccaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 329 - DNA, 359 bp, Artificial
  MsCOMT deletion introduced by TALEN pair MsCOMT_T01.1
tctcacaaaacctcatcaatcacaaccatgggttcaacaggtgaaactccaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 330 - DNA, 356 bp, Artificial
  MsCOMT deletion introduced by TALEN pair MsCOMT_T01.1
tctcacaaaacctcatcaatcacaaccatgggttcaacaggtgaaactccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 331 - DNA, 348 bp, Artificial
  MsCOMT deletion introduced by TALEN pair MsCOMT_T01.1
tctcacaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 332 - DNA, 354 bp, Artificial
  MsCOMT deletion introduced by TALEN pair MsCOMT_T01.1
tctcacaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 333 - DNA, 358 bp, Artificial
  MsCOMT deletion introduced by TALEN pair MsCOMT_T01.1
tctcacaaaacctcatcaatcacaaccatgggttcaacaggtgaaactcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 334 - DNA, 358 bp, Artificial
  MsCOMT deletion introduced by TALEN pair MsCOMT_T01.1
tctcacaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 335 - DNA, 364 bp, Artificial
  MsCOMT deletion introduced by TALEN pair MsCOMT_T01.1
tctcacaaaacctcatcaatcacaaccatgggttcaacaggtgaaactcaataacaccaacccacatatcagatgaagaagcaaacctcttcgccatgcaactagtaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 336 - DNA, 344 bp, Artificial
  MsCOMT deletion introduced by TALEN pair MsCOMT_T01.1
tctcacaaaacctcatcaatcacaaccatgggttcaacaggtgaaactcaagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 337 - DNA, 344 bp, Artificial
  MsCOMT deletion introduced by TALEN pair MsCOMT_T01.1
tctcacaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgattgttgcgtctcttggcttgttacaatatcctcacttgttctgttcgtactcaacaagatggaaaggttcagagactttatggtttggctactgttgctaa

SEQ ID NO: 338 - DNA, 344 bp, Artificial
  MsCOMT deletion introduced by TALEN pair MsCOMT_T01.1
tctcacaaaacctcatcaatcacaaccatgggttcaacaggtgaaactcaagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 339 - DNA, 344 bp, Artificial
  MsCOMT deletion introduced by TALEN pair MsCOMT_T01.1
tctcacaaaacctcatcaatcacaaccatgggttcaacaggtgaaactcaagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 340 - DNA, 355 bp, Artificial
  MsCOMT deletion introduced by TALEN pair MsCOMT_T01.1
tctcacaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 341 - DNA, 355 bp, Artificial
  MsCOMT deletion introduced by TALEN pair MsCOMT_T01.1
tctcacaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 342 - DNA, 355 bp, Artificial
  MsCOMT deletion introduced by TALEN pair MsCOMT_T01.1
tctcacaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 343 - DNA, 355 bp, Artificial
  MsCOMT deletion introduced by TALEN pair MsCOMT_T01.1
tctcacaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 344 - DNA, 355 bp, Artificial
  MsCOMT deletion introduced by TALEN pair MsCOMT_T01.1
tctcacaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 345 - DNA, 355 bp, Artificial
  MsCOMT deletion introduced by TALEN pair MsCOMT_T01.1
tctcacaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 346 - DNA, 355 bp, Artificial
  MsCOMT deletion introduced by TALEN pair MsCOMT_T01.1
tctcacaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggcgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 347 - DNA, 355 bp, Artificial
  MsCOMT deletion introduced by TALEN pair MsCOMT_T01.1
tctcacaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 348 - DNA, 355 bp, Artificial
  MsCOMT deletion introduced by TALEN pair MsCOMT_T01.1
tctcacaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 349 - DNA, 359 bp, Artificial
  MsCOMT deletion introduced by TALEN pair MsCOMT_T01.1
tctcacaaaacctcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 350 - DNA, 353 bp, Artificial
  MsCOMT deletion introduced by TALEN pair MsCOMT_T01.1
tctcacaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 351 - DNA, 358 bp, Artificial
  MsCOMT deletion introduced by TALEN pair MsCOMT_T01.1
tctcacaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 352 - DNA, 358 bp, Artificial
  MsCOMT deletion introduced by TALEN pair MsCOMT_T01.1
tctcacaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 353 - DNA, 358 bp, Artificial
  MsCOMT deletion introduced by TALEN pair MsCOMT_T01.1
tctcacaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 354 - DNA, 358 bp, Artificial
  MsCOMT deletion introduced by TALEN pair MsCOMT_T01.1
tctcacaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 355 - DNA, 358 bp, Artificial
  MsCOMT deletion introduced by TALEN pair MsCOMT_T01.1
tctcacaaaacctcatcaatcacaaccatgggttcaacaggtgaaactcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 356 - DNA, 365 bp, Artificial
  MsCOMT deletion introduced by TALEN pair MsCOMT_T01.1
tctcacaaaacctcatcaatcacaaccatgggttcaacaggtgaaactcaaatttttttaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 357 - DNA, 359 bp, Artificial
  MsCOMT deletion introduced by TALEN pair MsCOMT_T01.1
tctcacaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 358 - DNA, 357 bp, Artificial
  MsCOMT deletion introduced by TALEN pair MsCOMT_T01.1
tctcacaaaacctcatcaatcacaaccatgggttcaacaggtgaaactcaaatcccacatatcagatgaagaagcaaacctcttcgccctgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 359 - DNA, 357 bp, Artificial
  MsCOMT deletion introduced by TALEN pair MsCOMT_T01.1
tctcacaaaacctcatcaatcacaaccatgggttcaacaggtgaaactcaaatcccacatatcagatgaagaagcaaacctcttcgccctgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 360 - DNA, 356 bp, Artificial
  MsCOMT deletion introduced by TALEN pair MsCOMT_T01.1
tctcacaaaacctcatcaatcacaaccatgggttcaacaggtgaaactcaaatcccacatatcagatgaagaagcaaacctcttcgccatgcaactagcaagtgcttcagttctttccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 361 - DNA, 356 bp, Artificial
  MsCOMT deletion introduced by TALEN pair MsCOMT_T01.1
tctcacaaaacctcatcaatcacaaccatgggttcaacaggtgaaactcaaatccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 362 - DNA, 356 bp, Artificial
  MsCOMT deletion introduced by TALEN pair MsCOMT_T01.1
tctcacaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 363 - DNA, 361 bp, Artificial
  MsCOMT deletion introduced by TALEN pair MsCOMT_T01.1
tctcacaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 364 - DNA, 359 bp, Artificial
  MsCOMT deletion introduced by TALEN pair MsCOMT_T01.1
tctcacaaaacctcatcaatcacaaccatgggttcaacaggtgaaactcaaatcacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttgtggtttggctactgttgctaa

SEQ ID NO: 365 - DNA, 359 bp, Artificial
  MsCOMT deletion introduced by TALEN pair MsCOMT_T01.1
tctcacaaaacctcatcaatcacaaccatgggttcaacaggtgaaactcaaatcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 366 - DNA, 359 bp, Artificial
  MsCOMT deletion introduced by TALEN pair MsCOMT_T01.1
tctcacaaaacctcatcaatcacaaccatgggttcaacaggtgaaactcaaatcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 367 - DNA, 359 bp, Artificial
  MsCOMT deletion introduced by TALEN pair MsCOMT_T01.1
tctcacaaaacctcatcaatcacaaccatgggttcaacaggtgaaactcaaatcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 368 - DNA, 363 bp, Artificial
  MsCOMT deletion introduced by TALEN pair MsCOMT_T01.1
tctcacaaaacctcatcaatcacaaccatgggttcaacaggtgaaactcaaatcacaccaacccatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 369 - DNA, 360 bp, Artificial
  MsCOMT deletion introduced by TALEN pair MsCOMT_T01.1
tctcacaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 370 - DNA, 360 bp, Artificial
  MsCOMT deletion introduced by TALEN pair MsCOMT_T01.1
tctcacaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 371 - DNA, 360 bp, Artificial
  MsCOMT deletion introduced by TALEN pair MsCOMT_T01.1
tctcacaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 372 - DNA, 360 bp, Artificial
  MsCOMT deletion introduced by TALEN pair MsCOMT_T01.1
tctcacaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 373 - DNA, 350 bp, Artificial
  MsCOMT deletion introduced by TALEN pair MsCOMT_T01.1
tctcacaaaacctcatcaatcacaaccatgggttcaacaggtgaaactcaaatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 374 - DNA, 350 bp, Artificial
  MsCOMT deletion introduced by TALEN pair MsCOMT_T01.1
tctcacaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 375 - DNA, 358 bp, Artificial
  MsCOMT deletion introduced by TALEN pair MsCOMT_T01.1
tctcacaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 376 - DNA, 358 bp, Artificial
  MsCOMT deletion introduced by TALEN pair MsCOMT_T01.1
tctcacaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 377 - DNA, 358 bp, Artificial
  MsCOMT deletion introduced by TALEN pair MsCOMT_T01.1
tctcacaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 378 - DNA, 358 bp, Artificial
  MsCOMT deletion introduced by TALEN pair MsCOMT_T01.1
tctcacaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 379 - DNA, 358 bp, Artificial
  MsCOMT deletion introduced by TALEN pair MsCOMT_T01.1
tctcacaaaacctcatcaatcacaaccatgggttcaacaggtgaaactcaaatacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 380 - DNA, 358 bp, Artificial
  MsCOMT deletion introduced by TALEN pair MsCOMT_T01.1
tctcacaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 381 - DNA, 358 bp, Artificial
  MsCOMT deletion introduced by TALEN pair MsCOMT_T01.1
tctcacaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 382 - DNA, 358 bp, Artificial
  MsCOMT deletion introduced by TALEN pair MsCOMT_T01.1
tctcacaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 383 - DNA, 362 bp, Artificial
  MsCOMT deletion introduced by TALEN pair MsCOMT_T01.1
tctcacaaaacctcatcaatcacaaccatgggttcaacaggtgaaactcaaataccaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 384 - DNA, 362 bp, Artificial
  MsCOMT deletion introduced by TALEN pair MsCOMT_T01.1
tctcacaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 385 - DNA, 358 bp, Artificial
  MsCOMT deletion introduced by TALEN pair MsCOMT_T01.1
tctcacaaaacctcatcaatcacaaccatgggttcaacaggtgaaactcaaataccaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttattttggaccgaatgttgcgtctcttggcttgttacaatatcctcacttgttcagttcgttctcaacaagatgtaaaggttcagagactttatggtttggctacttttgctaa

SEQ ID NO: 386 - DNA, 364 bp, Artificial
  MsCOMT deletion introduced by TALEN pair MsCOMT_T01.1
tctcacaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 387 - DNA, 361 bp, Artificial
  MsCOMT deletion introduced by TALEN pair MsCOMT_T01.1
tctcacaaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 388 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatgagatgaagaagcaaacctcttcgccatgcaattagcaagtgcttcagttcttcccatgattttaaaatcagctctttaacttgatctcttagaaatcattgctaaagctggacctgatgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 389 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 390 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 391 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgtcgcgtctcttggcttgttacaatatcctcacttgttcagttcgtactcaacaagatggaaagattcagagactttatggtttggctactgttgctaa

SEQ ID NO: 392 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 393 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 394 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 395 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 396 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 397 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 398 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacatattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 399 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 400 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcatttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 401 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 402 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 403 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 404 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 405 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 406 - DNA, 358 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 407 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 408 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 409 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggacagaatgttgcgtcgcttggcttgttaaaatatcctcacttgttcagttcgtactcaacaagatggagagattcagagcctttatggtttggcgactgttgctaa

SEQ ID NO: 410 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 411 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 412 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 413 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 414 - DNA, 359 bp, Artificial
  MsCOMT deletion introduced by TALEN pair MsCOMT_T01.1
tctcacaaaacctcatcaatcacaaccatgggttcaacaggtgaaactcaaataacccacatatcagatgaagaagcaaacctcttcgccatgcaactagcaagtgcttcaattcttcccatgattttgaaatcagctcttgaacttgatctcttagaaatcattgctaaagctggacctggtgctcaaatttcacctattgaaattgcttcgcagctaccaacaactaaccctgatgcaccagttatgttgtaccgaatgttgcgtctattggcttgttacaatatcctcacttgttcagttcgtactcaacaaggtgtaaaggatcagagactttatggtttggcgacttttgctaa

SEQ ID NO: 415 - DNA, 358 bp, Artificial
  MsCOMT deletion introduced by TALEN pair MsCOMT_T01.1
tctcacaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 416 - DNA, 363 bp, Artificial
  MsCOMT deletion introduced by TALEN pair MsCOMT_T01.1
tctcacaaaacctcatcaatcacaaccatgggttcaacaggtgaaactcaaataaccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 417 - DNA, 363 bp, Artificial
  MsCOMT deletion introduced by TALEN pair MsCOMT_T01.1
tctcacaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 418 - DNA, 363 bp, Artificial
  MsCOMT deletion introduced by TALEN pair MsCOMT_T01.1
tctcacaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 419 - DNA, 363 bp, Artificial
  MsCOMT deletion introduced by TALEN pair MsCOMT_T01.1
tctcacaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 420 - DNA, 363 bp, Artificial
  MsCOMT deletion introduced by TALEN pair MsCOMT_T01.1
tctcacaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 421 - DNA, 363 bp, Artificial
  MsCOMT deletion introduced by TALEN pair MsCOMT_T01.1
tctcacaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 422 - DNA, 363 bp, Artificial
  MsCOMT deletion introduced by TALEN pair MsCOMT_T01.1
tctcacaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 423 - DNA, 363 bp, Artificial
  MsCOMT deletion introduced by TALEN pair MsCOMT_T01.1
tctcacaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 424 - DNA, 355 bp, Artificial
  MsCOMT deletion introduced by TALEN pair MsCOMT_T01.1
tctcacaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 425 - DNA, 355 bp, Artificial
  MsCOMT deletion introduced by TALEN pair MsCOMT_T01.1
tctcacaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 426 - DNA, 350 bp, Artificial
  MsCOMT deletion introduced by TALEN pair MsCOMT_T01.1
tctcacaaaacctcatcaatcacaaccatgggttcaacaggtgaaactcaaataacagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 427 - DNA, 364 bp, Artificial
  MsCOMT deletion introduced by TALEN pair MsCOMT_T01.1
tctcacaaaacctcatcaatcacaaccatgggttcaacaggtgaaactcaaataacacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 428 - DNA, 362 bp, Artificial
  MsCOMT deletion introduced by TALEN pair MsCOMT_T01.1
tctcacaaaacctcatcaatcacaaccatgggttcaacaggtgaaactcaaataacaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 429 - DNA, 362 bp, Artificial
  MsCOMT deletion introduced by TALEN pair MsCOMT_T01.1
tctcacaaaacctcatcaatcacaaccatgggttcaacaggtgaaactcaaataacaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 430 - DNA, 362 bp, Artificial
  MsCOMT deletion introduced by TALEN pair MsCOMT_T01.1
tctcacaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 431 - DNA, 362 bp, Artificial
  MsCOMT deletion introduced by TALEN pair MsCOMT_T01.1
tctcacaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 432 - DNA, 414 bp, Artificial
  MsCOMT deletion introduced by TALEN pair MsCOMT_T01.1
tctcacaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 433 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 434 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 435 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 436 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 437 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 438 - DNA, 359 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 439 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 440 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 441 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 442 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgcacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 443 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 444 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 445 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 446 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 447 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 448 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 449 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 450 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 451 - DNA, 360 bp, Artificial
  MsCOMT deletion introduced by TALEN pair MsCOMT_T01.1
tctcacaaaacctcatcaatcacaaccatgggttcaacaggtgaaactcaaataaacccacatatcagatgaagaagcaaacatcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgagtctcttggcttgttacaatatcctcacttgttcagttcgtactcaacaagatggaaagattcagagactttatggtttggctactgttgctaa

SEQ ID NO: 452 - DNA, 363 bp, Artificial
  MsCOMT deletion introduced by TALEN pair MsCOMT_T01.1
tctcacaaaacctcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 453 - DNA, 361 bp, Artificial
  MsCOMT deletion introduced by TALEN pair MsCOMT_T01.1
tctcacaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 454 - DNA, 361 bp, Artificial
  MsCOMT deletion introduced by TALEN pair MsCOMT_T01.1
tctcacaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 455 - DNA, 361 bp, Artificial
  MsCOMT deletion introduced by TALEN pair MsCOMT_T01.1
tctcacaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 456 - DNA, 361 bp, Artificial
  MsCOMT deletion introduced by TALEN pair MsCOMT_T01.1
tctcacaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 457 - DNA, 361 bp, Artificial
  MsCOMT deletion introduced by TALEN pair MsCOMT_T01.1
tctcacaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 458 - DNA, 361 bp, Artificial
  MsCOMT deletion introduced by TALEN pair MsCOMT_T01.1
tctcacaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 459 - DNA, 361 bp, Artificial
  MsCOMT deletion introduced by TALEN pair MsCOMT_T01.1
tctcacaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 460 - DNA, 361 bp, Artificial
  MsCOMT deletion introduced by TALEN pair MsCOMT_T01.1
tctcacaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 461 - DNA, 423 bp, Artificial
  MsCOMT deletion introduced by TALEN pair MsCOMT_T01.1
tctcacaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 462 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 463 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 464 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 465 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 466 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 467 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 468 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 469 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 470 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 471 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 472 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 473 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 474 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 475 - DNA, 356 bp, Artificial
  MsCOMT deletion introduced by TALEN pair MsCOMT_T01.1
tctcacaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 476 - DNA, 359 bp, Artificial
  MsCOMT deletion introduced by TALEN pair MsCOMT_T01.1
tctcacaaaacctcatcaatcacaaccatgggttcaacaggtgaaactcaaaccacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagctcgtactcaacaagatggaaaggttcagagactttatggtttggctactgttgctaa

SEQ ID NO: 477 - DNA, 359 bp, Artificial
  MsCOMT deletion introduced by TALEN pair MsCOMT_T01.1
tctcacaaaacctcatcaatcacaaccatgggttcaacaggtgaaactcaaaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 478 - DNA, 360 bp, Artificial
  MsCOMT deletion introduced by TALEN pair MsCOMT_T01.1
tctcacaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 479 - DNA, 354 bp, Artificial
  MsCOMT deletion introduced by TALEN pair MsCOMT_T01.1
tctcacaaaacctcatcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 480 - DNA, 359 bp, Artificial
  MsCOMT deletion introduced by TALEN pair MsCOMT_T01.1
tctcacaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttataaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 481 - DNA, 359 bp, Artificial
  MsCOMT deletion introduced by TALEN pair MsCOMT_T01.1
tctcacaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 482 - DNA, 359 bp, Artificial
  MsCOMT deletion introduced by TALEN pair MsCOMT_T01.1
tctcacaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 483 - DNA, 359 bp, Artificial
  MsCOMT deletion introduced by TALEN pair MsCOMT_T01.1
tctcacaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 484 - DNA, 357 bp, Artificial
  MsCOMT deletion introduced by TALEN pair MsCOMT_T01.1
tctcacaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 485 - DNA, 357 bp, Artificial
  MsCOMT deletion introduced by TALEN pair MsCOMT_T01.1
tctcacaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 486 - DNA, 357 bp, Artificial
  MsCOMT deletion introduced by TALEN pair MsCOMT_T01.1
tctcacaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 487 - DNA, 357 bp, Artificial
  MsCOMT deletion introduced by TALEN pair MsCOMT_T01.1
tctcacaaaacctcatcaatcacaaccatgggttcaacaggtgaaactcaaaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 488 - DNA, 357 bp, Artificial
  MsCOMT deletion introduced by TALEN pair MsCOMT_T01.1
tctcacaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 489 - DNA, 357 bp, Artificial
  MsCOMT deletion introduced by TALEN pair MsCOMT_T01.1
tctcacaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 490 - DNA, 357 bp, Artificial
  MsCOMT deletion introduced by TALEN pair MsCOMT_T01.1
tctcacaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 491 - DNA, 352 bp, Artificial
  MsCOMT deletion introduced by TALEN pair MsCOMT_T01.1
tctcacaaaacctcatcaatcacaaccatgggttcaacaggtgaaactcaaaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 492 - DNA, 358 bp, Artificial
  MsCOMT deletion introduced by TALEN pair MsCOMT_T01.1
tctcacaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 493 - DNA, 358 bp, Artificial
  MsCOMT deletion introduced by TALEN pair MsCOMT_T01.1
tctcacaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 494 - DNA, 358 bp, Artificial
  MsCOMT deletion introduced by TALEN pair MsCOMT_T01.1
tctcacaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 495 - DNA, 359 bp, Artificial
  MsCOMT deletion introduced by TALEN pair MsCOMT_T01.1
tctcacaaaacctcatcaatcacaaccatgggttcaacaggtgaaactaaaatcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 496 - DNA, 350 bp, Artificial
  MsCOMT deletion introduced by TALEN pair MsCOMT_T01.1
tctcacaaaacctcatcaatcacaaccatgggttcaacaggtgaaacccccatatcagatgaataagcaaacctcttcgccatgcaattagcaagtgcttcagatcttcccatgattttaaaatcagctcttgaacttgatctcttagaaatcattgctaaagctggacctggtgctcaaatttcacctgttcaaattgcttctcagctcccaacaactaaccctgatgcaccagatatgttggaccgaatgttgcgtctcttggcttgttacaatatcctcacttgttcagttcgtactcaacaagatggaaaggttcagagactttatggtttggctactgttgctaa

SEQ ID NO: 497 - DNA, 350 bp, Artificial
  MsCOMT deletion introduced by TALEN pair MsCOMT_T01.1
tctcacaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 498 - DNA, 350 bp, Artificial
  MsCOMT deletion introduced by TALEN pair MsCOMT_T01.1
tctcacaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 499 - DNA, 350 bp, Artificial
  MsCOMT deletion introduced by TALEN pair MsCOMT_T01.1
tctcacaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 500 - DNA, 350 bp, Artificial
  MsCOMT deletion introduced by TALEN pair MsCOMT_T01.1
tctcacaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 501 - DNA, 350 bp, Artificial
  MsCOMT deletion introduced by TALEN pair MsCOMT_T01.1
tctcacaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 502 - DNA, 350 bp, Artificial
  MsCOMT deletion introduced by TALEN pair MsCOMT_T01.1
tctcacaaaacctcatcaatcacaaccatgggttcaacaggtgaaacccacatatcagatgaacaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 503 - DNA, 360 bp, Artificial
  MsCOMT deletion introduced by TALEN pair MsCOMT_T01.1
tctcacaaaacctcatcaatcacaaccatgggttcaacaggtgaaacccaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 504 - DNA, 352 bp, Artificial
  MsCOMT deletion introduced by TALEN pair MsCOMT_T01.1
tctcacaaaacctcatcaatcacaaccatgggttcaacaggtgaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 505 - DNA, 331 bp, Artificial
  MsCOMT deletion introduced by TALEN pair MsCOMT_T01.1
tctcacaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 506 - DNA, 331 bp, Artificial
  MsCOMT deletion introduced by TALEN pair MsCOMT_T01.1
tctcacaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 507 - DNA, 331 bp, Artificial
  MsCOMT deletion introduced by TALEN pair MsCOMT_T01.1
tctcacaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 508 - DNA, 351 bp, Artificial
  MsCOMT deletion introduced by TALEN pair MsCOMT_T01.1
tctcacaaaacctcatcaatcacaaccatgggttcaacaggtgaaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 509 - DNA, 351 bp, Artificial
  MsCOMT deletion introduced by TALEN pair MsCOMT_T01.1
tctcacaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 510 - DNA, 351 bp, Artificial
  MsCOMT deletion introduced by TALEN pair MsCOMT_T01.1
tctcacaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 511 - DNA, 359 bp, Artificial
  MsCOMT deletion introduced by TALEN pair MsCOMT_T01.1
tctcacaaaacctcatcaatcacaaccatgggttcaacaggagaaactcaaataacccacatatcagatgaagaagcaaacctcttcgccatgcaattagcaagtgcttcagttcatcccatgattttaaaatcagctcttgaacttgatctcttagaaatcattgctaaagctggacctggtgctcaaatttcacctattgaaattgcgtctcagctaccaacaactaaccctgatgcaccagttatgttggaccgaatgttgcgtctcttggcttgttacaatatcctcacttgttcagttcgtcctcaacaagatggaaagattcagagactttatggtttggctactgttgctaa

SEQ ID NO: 512 - DNA, 343 bp, Artificial
  MsCOMT deletion introduced by TALEN pair MsCOMT_T01.1
tctcacaaaacctcatcaatcacaaccatgggttcaacacccccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 513 - DNA, 343 bp, Artificial
  MsCOMT deletion introduced by TALEN pair MsCOMT_T01.1
tctcacaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 514 - DNA, 346 bp, Artificial
  MsCOMT deletion introduced by TALEN pair MsCOMT_T01.1
tctcacaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 515 - DNA, 359 bp, Artificial
  MsCOMT deletion introduced by TALEN pair MsCOMT_T01.1
tctcacaaaacctcataatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 516 - DNA, 355 bp, Artificial
  MsCOMT deletion introduced by TALEN pair MsCOMT_T01.1
tctcacaaaacctcataatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 517 - DNA, 359 bp, Artificial
  MsCOMT deletion introduced by TALEN pair MsCOMT_T01.1
tctcacaaaacctcagcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 518 - DNA, 360 bp, Artificial
  MsCOMT deletion introduced by TALEN pair MsCOMT_T01.1
tctcacaaaacctcacaatcacaaccatgggttcaacaggtgaaactcaaataatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 519 - DNA, 358 bp, Artificial
  MsCOMT deletion introduced by TALEN pair MsCOMT_T01.1
tctcacaaaacctcacaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaaggttcagagactttatggtttggctactgttgctaa

SEQ ID NO: 520 - DNA, 359 bp, Artificial
  MsCOMT deletion introduced by TALEN pair MsCOMT_T01.1
tctcacaaaacctcacaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 521 - DNA, 332 bp, Artificial
  MsCOMT deletion introduced by TALEN pair MsCOMT_T01.1
tctcacaaaacctcacaatcacaaccatggcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 522 - DNA, 359 bp, Artificial
  MsCOMT deletion introduced by TALEN pair MsCOMT_T01.1
tctcacaaaacctatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 523 - DNA, 353 bp, Artificial
  MsCOMT deletion introduced by TALEN pair MsCOMT_T01.1
tctcacaaaacctatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttggtcagttcgtactcaacaagatggaaagattcagagactttctggtttggactgttgctaa

SEQ ID NO: 524 - DNA, 360 bp, Artificial
  MsCOMT deletion introduced by TALEN pair MsCOMT_T01.1
tctcacaaaaccctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcgaa

SEQ ID NO: 525 - DNA, 356 bp, Artificial
  MsCOMT deletion introduced by TALEN pair MsCOMT_T01.1
tctcacaaaacatcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 526 - DNA, 354 bp, Artificial
  MsCOMT deletion introduced by TALEN pair MsCOMT_T01.1
tctcacaaaacatcatcaatcacaaccatgggttcaacaggtgaaaccaacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 527 - DNA, 346 bp, Artificial
  MsCOMT deletion introduced by TALEN pair MsCOMT_T01.1
tctcacaaaacatcaatcacaaccatgggttcaacaggtgaaactcaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 528 - DNA, 356 bp, Artificial
  MsCOMT deletion introduced by TALEN pair MsCOMT_T01.1
tctcacaaaacatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 529 - DNA, 364 bp, Artificial
  MsCOMT deletion introduced by TALEN pair MsCOMT_T01.1
tctcacaaaaatctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 530 - DNA, 358 bp, Artificial
  MsCOMT deletion introduced by TALEN pair MsCOMT_T01.1
tctcacaaaaatcatcaatcacaaccatgggttcaacaggtgcaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 531 - DNA, 358 bp, Artificial
  MsCOMT deletion introduced by TALEN pair MsCOMT_T01.1
tctcacaaaaatcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 532 - DNA, 359 bp, Artificial
  MsCOMT deletion introduced by TALEN pair MsCOMT_T01.1
tctcacaaaaatcaatcacaaccatgggttcaacaggtgaaactcaaataacccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 533 - DNA, 359 bp, Artificial
  MsCOMT deletion introduced by TALEN pair MsCOMT_T01.1
tctcacaaaaatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 534 - DNA, 357 bp, Artificial
  MsCOMT deletion introduced by TALEN pair MsCOMT_T01.1
tctcacaaaaacttcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 535 - DNA, 360 bp, Artificial
  MsCOMT deletion introduced by TALEN pair MsCOMT_T01.1
tctcacaaaaacttcatcaatcacaaccatgggttcaacaggtgaaactcaaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 536 - DNA, 359 bp, Artificial
  MsCOMT deletion introduced by TALEN pair MsCOMT_T01.1
tctcacaaaaactcctcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 537 - DNA, 363 bp, Artificial
  MsCOMT deletion introduced by TALEN pair MsCOMT_T01.1
tctcacaaaaactcctcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 538 - DNA, 360 bp, Artificial
  MsCOMT deletion introduced by TALEN pair MsCOMT_T01.1
tctcacaaaaactcctcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 539 - DNA, 343 bp, Artificial
  MsCOMT deletion introduced by TALEN pair MsCOMT_T01.1
tctcacaaaaactcctcaatcacaaccatgggttcaacacccccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 540 - DNA, 359 bp, Artificial
  MsCOMT deletion introduced by TALEN pair MsCOMT_T01.1
tctcacaaaaactcatcaatcacaaccattggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 541 - DNA, 341 bp, Artificial
  MsCOMT deletion introduced by TALEN pair MsCOMT_T01.1
tctcacaaaaactcatcaatcacaaccatgggttcaacccacatatcagatgacgaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 542 - DNA, 341 bp, Artificial
  MsCOMT deletion introduced by TALEN pair MsCOMT_T01.1
tctcacaaaaactcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 543 - DNA, 351 bp, Artificial
  MsCOMT deletion introduced by TALEN pair MsCOMT_T01.1
tctcacaaaaactcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 544 - DNA, 351 bp, Artificial
  MsCOMT deletion introduced by TALEN pair MsCOMT_T01.1
tctcacaaaaactcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 545 - DNA, 332 bp, Artificial
  MsCOMT deletion introduced by TALEN pair MsCOMT_T01.1
tctcacaaaaactcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 546 - DNA, 349 bp, Artificial
  MsCOMT deletion introduced by TALEN pair MsCOMT_T01.1
tctcacaaaaactcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 547 - DNA, 349 bp, Artificial
  MsCOMT deletion introduced by TALEN pair MsCOMT_T01.1
tctcacaaaaactcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 548 - DNA, 350 bp, Artificial
  MsCOMT deletion introduced by TALEN pair MsCOMT_T01.1
tctcacaaaaactcatcaatcacaaccatgggttcaacaggtgaaatccacagatcagatgaagaagcaaaaataatagccatgcaactagcaagtgcttcagttcttcccatgattttaaaatcagctcttgaacttgatctcttagaaatcattgctaaagctggacctggtgctcaaatttcacctattgaacttgcttctcagctaccatcaactaaccctgatgcaccagttatgttggaccgcatgtttcgtctcttatcttgccccaagaaccgcacgggggcaggacgtactcaacaagatggaaattttcctcctctttatggtttggctactgttgctaa

SEQ ID NO: 549 - DNA, 354 bp, Artificial
  MsCOMT deletion introduced by TALEN pair MsCOMT_T01.1
tctcacaaaaactcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacgttgctaa

SEQ ID NO: 550 - DNA, 354 bp, Artificial
  MsCOMT deletion introduced by TALEN pair MsCOMT_T01.1
tctcacaaaaactcatcaatcacaaccatgggttcaacaggtgaaactcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 551 - DNA, 349 bp, Artificial
  MsCOMT deletion introduced by TALEN pair MsCOMT_T01.1
tctcacaaaaactcatcaatcacaaccatgggttcaacaggtgaaactcaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 552 - DNA, 355 bp, Artificial
  MsCOMT deletion introduced by TALEN pair MsCOMT_T01.1
tctcacaaaaactcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 553 - DNA, 354 bp, Artificial
  MsCOMT deletion introduced by TALEN pair MsCOMT_T01.1
tctcacaaaaactcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 554 - DNA, 353 bp, Artificial
  MsCOMT deletion introduced by TALEN pair MsCOMT_T01.1
tctcacaaaaactcatcaatcacaaccatgggttcaacaggtgaaactcaacacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 555 - DNA, 360 bp, Artificial
  MsCOMT deletion introduced by TALEN pair MsCOMT_T01.1
tctcacaaaaactcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 556 - DNA, 360 bp, Artificial
  MsCOMT deletion introduced by TALEN pair MsCOMT_T01.1
tctcacaaaaactcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggacctaatgttgcgtctcttggcttgttacaatatcctcacttgttcagttcgtactcaacaagatggaaaggttcagagactttatggtttggctactcttgctaa

SEQ ID NO: 557 - DNA, 359 bp, Artificial
  MsCOMT deletion introduced by TALEN pair MsCOMT_T01.1
tctcacaaaaactcatcaatcacaaccatgggttcaacaggtgaaactcaaatcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 558 - DNA, 360 bp, Artificial
  MsCOMT deletion introduced by TALEN pair MsCOMT_T01.1
tctcacaaaaactcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactatatggtttggctactgttgctaa

SEQ ID NO: 559 - DNA, 350 bp, Artificial
  MsCOMT deletion introduced by TALEN pair MsCOMT_T01.1
tctcacaaaaactcatcaatcacaaccatgggttcaacaggtgaaactcaaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 560 - DNA, 358 bp, Artificial
  MsCOMT deletion introduced by TALEN pair MsCOMT_T01.1
tctcacaaaaactcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 561 - DNA, 358 bp, Artificial
  MsCOMT deletion introduced by TALEN pair MsCOMT_T01.1
tctcacaaaaactcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 562 - DNA, 358 bp, Artificial
  MsCOMT deletion introduced by TALEN pair MsCOMT_T01.1
tctcacaaaaactcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 563 - DNA, 358 bp, Artificial
  MsCOMT deletion introduced by TALEN pair MsCOMT_T01.1
tctcacaaaaactcatcaatcacaaccatgggttcaacaggtgaaactcaaatacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 564 - DNA, 358 bp, Artificial
  MsCOMT deletion introduced by TALEN pair MsCOMT_T01.1
tctcacaaaaactcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 565 - DNA, 358 bp, Artificial
  MsCOMT deletion introduced by TALEN pair MsCOMT_T01.1
tctcacaaaaactcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 566 - DNA, 444 bp, Artificial
  MsCOMT deletion introduced by TALEN pair MsCOMT_T01.1
tctcacaaaaactcatcaatcacaaccatgggttcaacaggtgaaactcaaataatggtggcaagcaggcgctggagacggtcctgcggctgttgccggtgctgtgccaggcccacggcttgaccccggagcaggtccaacccacatatcagatgaagcagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 567 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 568 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 569 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 570 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 571 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 572 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 573 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 574 - DNA, 358 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 575 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 576 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 577 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 578 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 579 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 580 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 581 - DNA, 359 bp, Artificial
  MsCOMT deletion introduced by TALEN pair MsCOMT_T01.1
tctcacaaaaactcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 582 - DNA, 358 bp, Artificial
  MsCOMT deletion introduced by TALEN pair MsCOMT_T01.1
tctcacaaaaactcatcaatcacaaccatgggttcaacaggtgaaactcaaataaccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 583 - DNA, 363 bp, Artificial
  MsCOMT deletion introduced by TALEN pair MsCOMT_T01.1
tctcacaaaaactcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 584 - DNA, 363 bp, Artificial
  MsCOMT deletion introduced by TALEN pair MsCOMT_T01.1
tctcacaaaaactcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 585 - DNA, 363 bp, Artificial
  MsCOMT deletion introduced by TALEN pair MsCOMT_T01.1
tctcacaaaaactcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 586 - DNA, 363 bp, Artificial
  MsCOMT deletion introduced by TALEN pair MsCOMT_T01.1
tctcacaaaaactcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 587 - DNA, 363 bp, Artificial
  MsCOMT deletion introduced by TALEN pair MsCOMT_T01.1
tctcacaaaaactcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 588 - DNA, 363 bp, Artificial
  MsCOMT deletion introduced by TALEN pair MsCOMT_T01.1
tctcacaaaaactcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 589 - DNA, 389 bp, Artificial
  MsCOMT deletion introduced by TALEN pair MsCOMT_T01.1
tctcacaaaaactcatcaatcacaaccatgggttcaacaggtgaaactcaaataacaccacctgctccggggtcaagccgtggtgctgacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 590 - DNA, 389 bp, Artificial
  MsCOMT deletion introduced by TALEN pair MsCOMT_T01.1
tctcacaaaaactcatcaatcacaaccatgggttcaacaggtgaaactcaaataacaccacctgctccggggtcaagccgtggtgctgacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 591 - DNA, 362 bp, Artificial
  MsCOMT deletion introduced by TALEN pair MsCOMT_T01.1
tctcacaaaaactcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacattgcttctcagctaccaacaactaaccctgatgcaccagttatgttggaccgaatgtggcgtctcttggcttgttacaatatcctcacttgtgcagttcgtactcaacaagatggaaaggttcagagcctttatggtttggctactggtgctaa

SEQ ID NO: 592 - DNA, 362 bp, Artificial
  MsCOMT deletion introduced by TALEN pair MsCOMT_T01.1
tctcacaaaaactcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 593 - DNA, 362 bp, Artificial
  MsCOMT deletion introduced by TALEN pair MsCOMT_T01.1
tctcacaaaaactcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 594 - DNA, 360 bp, Artificial
  MsCOMT deletion introduced by TALEN pair MsCOMT_T01.1
tctcacaaaaactcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 595 - DNA, 423 bp, Artificial
  MsCOMT deletion introduced by TALEN pair MsCOMT_T01.1
tctcacaaaaactcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 596 - DNA, 356 bp, Artificial
  MsCOMT deletion introduced by TALEN pair MsCOMT_T01.1
tctcacaaaaactcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 597 - DNA, 356 bp, Artificial
  MsCOMT deletion introduced by TALEN pair MsCOMT_T01.1
tctcacaaaaactcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 598 - DNA, 356 bp, Artificial
  MsCOMT deletion introduced by TALEN pair MsCOMT_T01.1
tctcacaaaaactcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 599 - DNA, 356 bp, Artificial
  MsCOMT deletion introduced by TALEN pair MsCOMT_T01.1
tctcacaaaaactcatcaatcacaaccatgggttcaacaggtgaaactcaaacccacatatcagatgaagaagcaaacctcttcgccatgcaactagcaagtgcttcagttcttcccatgattttaaaatcagctcttgtacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 600 - DNA, 359 bp, Artificial
  MsCOMT deletion introduced by TALEN pair MsCOMT_T01.1
tctcacaaaaactcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 601 - DNA, 359 bp, Artificial
  MsCOMT deletion introduced by TALEN pair MsCOMT_T01.1
tctcacaaaaactcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 602 - DNA, 359 bp, Artificial
  MsCOMT deletion introduced by TALEN pair MsCOMT_T01.1
tctcacaaaaactcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 603 - DNA, 357 bp, Artificial
  MsCOMT deletion introduced by TALEN pair MsCOMT_T01.1
tctcacaaaaactcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 604 - DNA, 357 bp, Artificial
  MsCOMT deletion introduced by TALEN pair MsCOMT_T01.1
tctcacaaaaactcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagctcgtactcaacaagatggaaaggttcagagactttatggtttggctactgttgctaa

SEQ ID NO: 605 - DNA, 357 bp, Artificial
  MsCOMT deletion introduced by TALEN pair MsCOMT_T01.1
tctcacaaaaactcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 606 - DNA, 357 bp, Artificial
  MsCOMT deletion introduced by TALEN pair MsCOMT_T01.1
tctcacaaaaactcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 607 - DNA, 357 bp, Artificial
  MsCOMT deletion introduced by TALEN pair MsCOMT_T01.1
tctcacaaaaactcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 608 - DNA, 358 bp, Artificial
  MsCOMT deletion introduced by TALEN pair MsCOMT_T01.1
tctcacaaaaactcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 609 - DNA, 358 bp, Artificial
  MsCOMT deletion introduced by TALEN pair MsCOMT_T01.1
tctcacaaaaactcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 610 - DNA, 358 bp, Artificial
  MsCOMT deletion introduced by TALEN pair MsCOMT_T01.1
tctcacaaaaactcatcaatcacaaccatgggttcaacaggtgaaactcaaaaacccacatatcagatgaagaagcaaacctcttcgccatgcaactaacaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 611 - DNA, 354 bp, Artificial
  MsCOMT deletion introduced by TALEN pair MsCOMT_T01.1
tctcacaaaaactcatcaatcacaaccatgggttcaacaggtgaaactcaaaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 612 - DNA, 345 bp, Artificial
  MsCOMT deletion introduced by TALEN pair MsCOMT_T01.1
tctcacaaaaactcatcaatcacaaccatgggttcaacaggtgaaactatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 613 - DNA, 331 bp, Artificial
  MsCOMT deletion introduced by TALEN pair MsCOMT_T01.1
tctcacaaaaactcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 614 - DNA, 343 bp, Artificial
  MsCOMT deletion introduced by TALEN pair MsCOMT_T01.1
tctcacaaaaactcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 615 - DNA, 346 bp, Artificial
  MsCOMT deletion introduced by TALEN pair MsCOMT_T01.1
tctcacaaaaactcatcaatcacaaccatgggttcaacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 616 - DNA, 333 bp, Artificial
  MsCOMT deletion introduced by TALEN pair MsCOMT_T01.1
tctcacaaaaactcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 617 - DNA, 333 bp, Artificial
  MsCOMT deletion introduced by TALEN pair MsCOMT_T01.1
tctcacaaaaactcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 618 - DNA, 360 bp, Artificial
  MsCOMT deletion introduced by TALEN pair MsCOMT_T01.1
tctcacaaaaactcatcaaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 619 - DNA, 358 bp, Artificial
  MsCOMT deletion introduced by TALEN pair MsCOMT_T01.1
tctcacaaaaactcataatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 620 - DNA, 360 bp, Artificial
  MsCOMT deletion introduced by TALEN pair MsCOMT_T01.1
tctcacaaaaactcacaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 621 - DNA, 356 bp, Artificial
  MsCOMT deletion introduced by TALEN pair MsCOMT_T01.1
tctcacaaaaactatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 622 - DNA, 359 bp, Artificial
  MsCOMT deletion introduced by TALEN pair MsCOMT_T01.1
tctcacaaaaacgtcatcaatcacaaccatgggttcaacaggtgaaactcaaatacacacatatcagatgaagaagcaaacctcttcgccatgaaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcacccgttatgttggaccgaatgttgcgtcgcttggcttgttacaatatcctcacttgttctgttcgtacccaacaagattgaaatgttcagagactttatggtttggctactgttgctaa

SEQ ID NO: 623 - DNA, 357 bp, Artificial
  MsCOMT deletion introduced by TALEN pair MsCOMT_T01.1
tctcacaaaaaccttcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 624 - DNA, 361 bp, Artificial
  MsCOMT deletion introduced by TALEN pair MsCOMT_T01.1
tctcacaaaaaccttcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttagctactgttgctaa

SEQ ID NO: 625 - DNA, 355 bp, Artificial
  MsCOMT deletion introduced by TALEN pair MsCOMT_T01.1
tctcacaaaaaccttcaatcacaaccatgggttcaacaggtgcaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 626 - DNA, 358 bp, Artificial
  MsCOMT deletion introduced by TALEN pair MsCOMT_T01.1
tctcacaaaaaccttcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 627 - DNA, 363 bp, Artificial
  MsCOMT deletion introduced by TALEN pair MsCOMT_T01.1
tctcacaaaaaccttatcaatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 628 - DNA, 360 bp, Artificial
  MsCOMT deletion introduced by TALEN pair MsCOMT_T01.1
tctcacaaaaaccttatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 629 - DNA, 364 bp, Artificial
  MsCOMT deletion introduced by TALEN pair MsCOMT_T01.1
tctcacaaaaaccttatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 630 - DNA, 348 bp, Artificial
  MsCOMT deletion introduced by TALEN pair MsCOMT_T01.1
tctcacaaaaaccttatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtggcgtctctcggcttgttacaatatcctcacttgttcagttcgtactcaacaagatggaaaggttcagagactttatggtttggctactgttgctaa

SEQ ID NO: 631 - DNA, 333 bp, Artificial
  MsCOMT deletion introduced by TALEN pair MsCOMT_T01.1
tctcacaaaaacctcttcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 632 - DNA, 359 bp, Artificial
  MsCOMT deletion introduced by TALEN pair MsCOMT_T01.1
tctcacaaaaacctcttcaatcacaaccatgggttcaacaggtgaaactcaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 633 - DNA, 363 bp, Artificial
  MsCOMT deletion introduced by TALEN pair MsCOMT_T01.1
tctcacaaaaacctcttcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 634 - DNA, 357 bp, Artificial
  MsCOMT deletion introduced by TALEN pair MsCOMT_T01.1
tctcacaaaaacctctcaatcacaaccattggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 635 - DNA, 359 bp, Artificial
  MsCOMT deletion introduced by TALEN pair MsCOMT_T01.1
tctcacaaaaacctctcaatcacaaccattggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 636 - DNA, 460 bp, Artificial
  MsCOMT deletion introduced by TALEN pair MsCOMT_T01.1
tctcacaaaaacctctcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 637 - DNA, 349 bp, Artificial
  MsCOMT deletion introduced by TALEN pair MsCOMT_T01.1
tctcacaaaaacctctcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 638 - DNA, 363 bp, Artificial
  MsCOMT deletion introduced by TALEN pair MsCOMT_T01.1
tctcacaaaaacctctcaatcacaaccatgggttcaacaggtgaaactccaataacaaacccacatatcagatgaagaagcaaacctcttctccatgcaattagcaagtgcttcagttcttcccatgattttaaaatcagctcttgaacttgatctcttagaaatcattgctaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 639 - DNA, 348 bp, Artificial
  MsCOMT deletion introduced by TALEN pair MsCOMT_T01.1
tctcacaaaaacctctcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 640 - DNA, 350 bp, Artificial
  MsCOMT deletion introduced by TALEN pair MsCOMT_T01.1
tctcacaaaaacctctcaatcacaaccatgggttcaacaggtgaaactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 641 - DNA, 355 bp, Artificial
  MsCOMT deletion introduced by TALEN pair MsCOMT_T01.1
tctcacaaaaacctctcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 642 - DNA, 355 bp, Artificial
  MsCOMT deletion introduced by TALEN pair MsCOMT_T01.1
tctcacaaaaacctctcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 643 - DNA, 355 bp, Artificial
  MsCOMT deletion introduced by TALEN pair MsCOMT_T01.1
tctcacaaaaacctctcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 644 - DNA, 355 bp, Artificial
  MsCOMT deletion introduced by TALEN pair MsCOMT_T01.1
tctcacaaaaacctctcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 645 - DNA, 359 bp, Artificial
  MsCOMT deletion introduced by TALEN pair MsCOMT_T01.1
tctcacaaaaacctctcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 646 - DNA, 359 bp, Artificial
  MsCOMT deletion introduced by TALEN pair MsCOMT_T01.1
tctcacaaaaacctctcaatcacaaccatgggttcaacaggtgaaactcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 647 - DNA, 351 bp, Artificial
  MsCOMT deletion introduced by TALEN pair MsCOMT_T01.1
tctcacaaaaacctctcaatcacaaccatgggttcaacaggtgaaactcaacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 648 - DNA, 359 bp, Artificial
  MsCOMT deletion introduced by TALEN pair MsCOMT_T01.1
tctcacaaaaacctctcaatcacaaccatgggttcaacaggtgaaactcaaatcacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 649 - DNA, 358 bp, Artificial
  MsCOMT deletion introduced by TALEN pair MsCOMT_T01.1
tctcacaaaaacctctcaatcacaaccatgggttcaacaggtgaaactcaaatcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttggctactgttgtaa

SEQ ID NO: 650 - DNA, 363 bp, Artificial
  MsCOMT deletion introduced by TALEN pair MsCOMT_T01.1
tctcacaaaaacctctcaatcacaaccatgggttcaacaggtgaaactcaaatcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 651 - DNA, 360 bp, Artificial
  MsCOMT deletion introduced by TALEN pair MsCOMT_T01.1
tctcacaaaaacctctcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 652 - DNA, 360 bp, Artificial
  MsCOMT deletion introduced by TALEN pair MsCOMT_T01.1
tctcacaaaaacctctcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 653 - DNA, 358 bp, Artificial
  MsCOMT deletion introduced by TALEN pair MsCOMT_T01.1
tctcacaaaaacctctcaatcacaaccatgggttcaacaggtgaaactcaaatacccacatatcagatgaagaagcaatcctcttcgccatgcaattagcaagtgcttcagttcttcccatgattttaaaatcagctcttgaacttgatctcttggaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 654 - DNA, 358 bp, Artificial
  MsCOMT deletion introduced by TALEN pair MsCOMT_T01.1
tctcacaaaaacctctcaatcacaaccatgggttcaacaggtgaaactcaaatacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 655 - DNA, 358 bp, Artificial
  MsCOMT deletion introduced by TALEN pair MsCOMT_T01.1
tctcacaaaaacctctcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 656 - DNA, 358 bp, Artificial
  MsCOMT deletion introduced by TALEN pair MsCOMT_T01.1
tctcacaaaaacctctcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 657 - DNA, 358 bp, Artificial
  MsCOMT deletion introduced by TALEN pair MsCOMT_T01.1
tctcacaaaaacctctcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 658 - DNA, 362 bp, Artificial
  MsCOMT deletion introduced by TALEN pair MsCOMT_T01.1
tctcacaaaaacctctcaatcacaaccatgggttcaacaggtgaaactcaaataccaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 659 - DNA, 359 bp, Artificial
  MsCOMT deletion introduced by TALEN pair MsCOMT_T01.1
tctcacaaaaacctctcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 660 - DNA, 359 bp, Artificial
  MsCOMT deletion introduced by TALEN pair MsCOMT_T01.1
tctcacaaaaacctctcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 661 - DNA, 359 bp, Artificial
  MsCOMT deletion introduced by TALEN pair MsCOMT_T01.1
tctcacaaaaacctctcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 662 - DNA, 359 bp, Artificial
  MsCOMT deletion introduced by TALEN pair MsCOMT_T01.1
tctcacaaaaacctctcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 663 - DNA, 359 bp, Artificial
  MsCOMT deletion introduced by TALEN pair MsCOMT_T01.1
tctcacaaaaacctctcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 664 - DNA, 359 bp, Artificial
  MsCOMT deletion introduced by TALEN pair MsCOMT_T01.1
tctcacaaaaacctctcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 665 - DNA, 359 bp, Artificial
  MsCOMT deletion introduced by TALEN pair MsCOMT_T01.1
tctcacaaaaacctctcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacacaacaagatggaaaagttcagagactttatggtttggctactgttgctaa

SEQ ID NO: 666 - DNA, 359 bp, Artificial
  MsCOMT deletion introduced by TALEN pair MsCOMT_T01.1
tctcacaaaaacctctcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 667 - DNA, 362 bp, Artificial
  MsCOMT deletion introduced by TALEN pair MsCOMT_T01.1
tctcacaaaaacctctcaatcacaaccatgggttcaacaggtgaaactcaaataaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 668 - DNA, 363 bp, Artificial
  MsCOMT deletion introduced by TALEN pair MsCOMT_T01.1
tctcacaaaaacctctcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 669 - DNA, 363 bp, Artificial
  MsCOMT deletion introduced by TALEN pair MsCOMT_T01.1
tctcacaaaaacctctcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctaccaacaactaaccctgatgcaccagttttgttggaccgaatgtttcgtctcttggcttgttacaatatcctcacttgttcagttcgtactcaactatattgaaaggttcagagactttatggtttggctactgttgctaa

SEQ ID NO: 670 - DNA, 363 bp, Artificial
  MsCOMT deletion introduced by TALEN pair MsCOMT_T01.1
tctcacaaaaacctctcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 671 - DNA, 355 bp, Artificial
  MsCOMT deletion introduced by TALEN pair MsCOMT_T01.1
tctcacaaaaacctctcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 672 - DNA, 364 bp, Artificial
  MsCOMT deletion introduced by TALEN pair MsCOMT_T01.1
tctcacaaaaacctctcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 673 - DNA, 362 bp, Artificial
  MsCOMT deletion introduced by TALEN pair MsCOMT_T01.1
tctcacaaaaacctctcaatcacaaccatgggttcaacaggtgaaactcaaataacaacccacatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 674 - DNA, 362 bp, Artificial
  MsCOMT deletion introduced by TALEN pair MsCOMT_T01.1
tctcacaaaaacctctcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 675 - DNA, 360 bp, Artificial
  MsCOMT deletion introduced by TALEN pair MsCOMT_T01.1
tctcacaaaaacctctcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 676 - DNA, 356 bp, Artificial
  MsCOMT deletion introduced by TALEN pair MsCOMT_T01.1
tctcacaaaaacctctcaatcacaaccatgggttcaacaggtgaaactcaaacccacatatcatatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 677 - DNA, 356 bp, Artificial
  MsCOMT deletion introduced by TALEN pair MsCOMT_T01.1
tctcacaaaaacctctcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 678 - DNA, 355 bp, Artificial
  MsCOMT deletion introduced by TALEN pair MsCOMT_T01.1
tctcacaaaaacctctcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 679 - DNA, 356 bp, Artificial
  MsCOMT deletion introduced by TALEN pair MsCOMT_T01.1
tctcacaaaaacctctcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 680 - DNA, 356 bp, Artificial
  MsCOMT deletion introduced by TALEN pair MsCOMT_T01.1
tctcacaaaaacctctcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 681 - DNA, 359 bp, Artificial
  MsCOMT deletion introduced by TALEN pair MsCOMT_T01.1
tctcacaaaaacctctcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 682 - DNA, 360 bp, Artificial
  MsCOMT deletion introduced by TALEN pair MsCOMT_T01.1
tctcacaaaaacctctcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 683 - DNA, 357 bp, Artificial
  MsCOMT deletion introduced by TALEN pair MsCOMT_T01.1
tctcacaaaaacctctcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 684 - DNA, 357 bp, Artificial
  MsCOMT deletion introduced by TALEN pair MsCOMT_T01.1
tctcacaaaaacctctcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 685 - DNA, 345 bp, Artificial
  MsCOMT deletion introduced by TALEN pair MsCOMT_T01.1
tctcacaaaaacctctcaatcacaaccatgggttcaacaggtgaaactatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 686 - DNA, 350 bp, Artificial
  MsCOMT deletion introduced by TALEN pair MsCOMT_T01.1
tctcacaaaaacctctcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 687 - DNA, 350 bp, Artificial
  MsCOMT deletion introduced by TALEN pair MsCOMT_T01.1
tctcacaaaaacctctcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 688 - DNA, 359 bp, Artificial
  MsCOMT deletion introduced by TALEN pair MsCOMT_T01.1
tctcacaaaaacctctcaatcacaaccatgggttcaacagatgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 689 - DNA, 343 bp, Artificial
  MsCOMT deletion introduced by TALEN pair MsCOMT_T01.1
tctcacaaaaacctctcaatcacaaccatgggttcaacacccccatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 690 - DNA, 346 bp, Artificial
  MsCOMT deletion introduced by TALEN pair MsCOMT_T01.1
tctcacaaaaacctctcaatcacaaccatgggttcaacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 691 - DNA, 344 bp, Artificial
  MsCOMT deletion introduced by TALEN pair MsCOMT_T01.1
tctcacaaaaacctctcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 692 - DNA, 342 bp, Artificial
  MsCOMT deletion introduced by TALEN pair MsCOMT_T01.1
tctcacaaaaacctctcaatcacaaccatgggttcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 693 - DNA, 352 bp, Artificial
  MsCOMT deletion introduced by TALEN pair MsCOMT_T01.1
tctcacaaaaacctctcaatcacaaccatgggtccaacaggtgaaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 694 - DNA, 362 bp, Artificial
  MsCOMT deletion introduced by TALEN pair MsCOMT_T01.1
tctcacaaaaacctcgtcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 695 - DNA, 360 bp, Artificial
  MsCOMT deletion introduced by TALEN pair MsCOMT_T01.1
tctcacaaaaacctcgtcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 696 - DNA, 363 bp, Artificial
  MsCOMT deletion introduced by TALEN pair MsCOMT_T01.1
tctcacaaaaacctcgtcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaacgttgcgtctcttggcttgttacaatatcctcacttgttcagttcgtactcaacaagatggaaaagttcagagactttatggtttggctactgttgctaa

SEQ ID NO: 697 - DNA, 345 bp, Artificial
  MsCOMT deletion introduced by TALEN pair MsCOMT_T01.1
tctcacaaaaacctcgtcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 698 - DNA, 358 bp, Artificial
  MsCOMT deletion introduced by TALEN pair MsCOMT_T01.1
tctcacaaaaacctcctcaatcacaaccatgggttcaacaggtgaaactcaaaacccacatatcagatgaagaagcaaacctattcgccatgcaattagcaagtgcttcagttcttaccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 699 - DNA, 362 bp, Artificial
  MsCOMT deletion introduced by TALEN pair MsCOMT_T01.1
tctcacaaaaacctcctcaatcacaaccatgggttcaacaggtgaaactaaaataaaacccacatatcagatgaagaagcaaacctcttcgccatgcaactagcaagtgcttcagttcttcccatgattttgaaatcaactcttgaacttgatctcttagaaatcattgctaaagctgtacctggtgctcaaatttcacctgttcaaattgcttctcagcttccaacaactaaccatgatgcaccagttatgttggaccgaatgttgcgtctcttggcttgttacaatgtcctcacttgttcagttcgtactcaacaagatggacaggttaagagactttatggtttggctaatgttgctaa

SEQ ID NO: 700 - DNA, 348 bp, Artificial
  MsCOMT deletion introduced by TALEN pair MsCOMT_T01.1
tctcacaaaaacctcctcaatcacaaccatgggttcaacaggtacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 701 - DNA, 361 bp, Artificial
  MsCOMT deletion introduced by TALEN pair MsCOMT_T01.1
tctcacaaaaacctcctcaatcacaaacatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 702 - DNA, 363 bp, Artificial
  MsCOMT deletion introduced by TALEN pair MsCOMT_T01.1
tctcacaaaaacctccatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 703 - DNA, 364 bp, Artificial
  MsCOMT deletion introduced by TALEN pair MsCOMT_T01.1
tctcacaaaaacctcattcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 704 - DNA, 361 bp, Artificial
  MsCOMT deletion introduced by TALEN pair MsCOMT_T01.1
tctcacaaaaacctcattcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 705 - DNA, 364 bp, Artificial
  MsCOMT deletion introduced by TALEN pair MsCOMT_T01.1
tctcacaaaaacctcattcaatcacaaccatgggttcaacaggtgaaactcaaataacaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtacgtactcaacaagatggaaaagttcagagactttatggtttggctactgttgctaa

SEQ ID NO: 706 - DNA, 356 bp, Artificial
  MsCOMT deletion introduced by TALEN pair MsCOMT_T01.1
tctcacaaaaacctcattcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 707 - DNA, 360 bp, Artificial
  MsCOMT deletion introduced by TALEN pair MsCOMT_T01.1
tctcacaaaaacctcattaatcacaaccatgggttcaacaggtgaaactcaaataacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 708 - DNA, 364 bp, Artificial
  MsCOMT deletion introduced by TALEN pair MsCOMT_T01.1
tctcacaaaaacctcattaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagttggaaaggttcagagactttatggtttggctactgttgctaa

SEQ ID NO: 709 - DNA, 363 bp, Artificial
  MsCOMT deletion introduced by TALEN pair MsCOMT_T01.1
tctcacaaaaacctcattaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 710 - DNA, 352 bp, Artificial
  MsCOMT deletion introduced by TALEN pair MsCOMT_T01.1
tctcacaaaaacctcattaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 711 - DNA, 354 bp, Artificial
  MsCOMT deletion introduced by TALEN pair MsCOMT_T01.1
tctcacaaaaacctcatgaatcacaaccatgggttcaacaggggaaactcaaataatatcagatgaagaagcaaacctcttcgccatgcaactagcaagtgcttcagttcttcccatgattttgaaatcagctcttgaacttgatctcttagaaatcattgctaaagctggacctggtgctcgaatttcacctattgaaattgcttctcagctaccaacaactaacgctgatgcaccagttatgttggactgaatgttgcgtctattggcttgttacaaattcctcacatgttaagttcgtaatcaatcaggtgtaaaggttcagagattttatggtctggagacaggtgctaa

SEQ ID NO: 712 - DNA, 359 bp, Artificial
  MsCOMT deletion introduced by TALEN pair MsCOMT_T01.1
tctcacaaaaacctcatctatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 713 - DNA, 361 bp, Artificial
  MsCOMT deletion introduced by TALEN pair MsCOMT_T01.1
tctcacaaaaacctcatctatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 714 - DNA, 354 bp, Artificial
  MsCOMT deletion introduced by TALEN pair MsCOMT_T01.1
tctcacaaaaacctcatcgatcacaaccatgggttcaacaggtgaaactcaaataatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 715 - DNA, 362 bp, Artificial
  MsCOMT deletion introduced by TALEN pair MsCOMT_T01.1
tctcacaaaaacctcatcgatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 716 - DNA, 360 bp, Artificial
  MsCOMT deletion introduced by TALEN pair MsCOMT_T01.1
tctcacaaaaacctcatccatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 717 - DNA, 360 bp, Artificial
  MsCOMT deletion introduced by TALEN pair MsCOMT_T01.1
tctcacaaaaacctcatccatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 718 - DNA, 360 bp, Artificial
  MsCOMT deletion introduced by TALEN pair MsCOMT_T01.1
tctcacaaaaacctcatccaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 719 - DNA, 360 bp, Artificial
  MsCOMT deletion introduced by TALEN pair MsCOMT_T01.1
tctcacaaaaacctcatcatcacaaccattggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 720 - DNA, 360 bp, Artificial
  MsCOMT deletion introduced by TALEN pair MsCOMT_T01.1
tctcacaaaaacctcatcatcacaaccatgggttcaacaggtgaaactccaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 721 - DNA, 355 bp, Artificial
  MsCOMT deletion introduced by TALEN pair MsCOMT_T01.1
tctcacaaaaacctcatcatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 722 - DNA, 359 bp, Artificial
  MsCOMT deletion introduced by TALEN pair MsCOMT_T01.1
tctcacaaaaacctcatcatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 723 - DNA, 359 bp, Artificial
  MsCOMT deletion introduced by TALEN pair MsCOMT_T01.1
tctcacaaaaacctcatcatcacaaccatgggttcaacaggtgaaactcaaatcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 724 - DNA, 360 bp, Artificial
  MsCOMT deletion introduced by TALEN pair MsCOMT_T01.1
tctcacaaaaacctcatcatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 725 - DNA, 360 bp, Artificial
  MsCOMT deletion introduced by TALEN pair MsCOMT_T01.1
tctcacaaaaacctcatcatcacaaccatgggttcaacaggtgaaactcaaatcaacccacatatcagatgaagaagcaaacctcttcgccatgcaactagcaagggcttcagttcttcccatgattttgaaatcagctcttgaacttgatctcttagaaatcattgctaaagcttgacctgatgctcaaatttcacctattgaactttcttctcagctaccaacaactaacccttatacaccagttattttagaccgattgtttcgtctcttggcttgttccaatatcctcacttgttcattccttacccaacaagattcaattcttcacagactttatggtttggctactgttgctaa

SEQ ID NO: 726 - DNA, 358 bp, Artificial
  MsCOMT deletion introduced by TALEN pair MsCOMT_T01.1
tctcacaaaaacctcatcatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 727 - DNA, 354 bp, Artificial
  MsCOMT deletion introduced by TALEN pair MsCOMT_T01.1
tctcacaaaaacctcatcatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 728 - DNA, 359 bp, Artificial
  MsCOMT deletion introduced by TALEN pair MsCOMT_T01.1
tctcacaaaaacctcatcatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 729 - DNA, 359 bp, Artificial
  MsCOMT deletion introduced by TALEN pair MsCOMT_T01.1
tctcacaaaaacctcatcatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 730 - DNA, 359 bp, Artificial
  MsCOMT deletion introduced by TALEN pair MsCOMT_T01.1
tctcacaaaaacctcatcatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 731 - DNA, 359 bp, Artificial
  MsCOMT deletion introduced by TALEN pair MsCOMT_T01.1
tctcacaaaaacctcatcatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 732 - DNA, 363 bp, Artificial
  MsCOMT deletion introduced by TALEN pair MsCOMT_T01.1
tctcacaaaaacctcatcatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 733 - DNA, 478 bp, Artificial
  MsCOMT deletion introduced by TALEN pair MsCOMT_T01.1
tctcacaaaaacctcatcatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 734 - DNA, 356 bp, Artificial
  MsCOMT deletion introduced by TALEN pair MsCOMT_T01.1
tctcacaaaaacctcatcatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 735 - DNA, 356 bp, Artificial
  MsCOMT deletion introduced by TALEN pair MsCOMT_T01.1
tctcacaaaaacctcatcatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 736 - DNA, 356 bp, Artificial
  MsCOMT deletion introduced by TALEN pair MsCOMT_T01.1
tctcacaaaaacctcatcatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 737 - DNA, 358 bp, Artificial
  MsCOMT deletion introduced by TALEN pair MsCOMT_T01.1
tctcacaaaaacctcatcatcacaaccatgggttcaacaggtgaaactcaaaaacccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 738 - DNA, 359 bp, Artificial
  MsCOMT deletion introduced by TALEN pair MsCOMT_T01.1
tctcacaaaaacctcatcatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 739 - DNA, 351 bp, Artificial
  MsCOMT deletion introduced by TALEN pair MsCOMT_T01.1
tctcacaaaaacctcatcatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 740 - DNA, 360 bp, Artificial
  MsCOMT deletion introduced by TALEN pair MsCOMT_T01.1
tctcacaaaaacctcatcagtcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 741 - DNA, 360 bp, Artificial
  MsCOMT deletion introduced by TALEN pair MsCOMT_T01.1
tctcacaaaaacctcatcagtcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 742 - DNA, 424 bp, Artificial
  MsCOMT deletion introduced by TALEN pair MsCOMT_T01.1
tctcacaaaaacctcatcagtcacaaccatgggttcaacaggtgaaactcaaagacacgacttatcgccactggcagcagcccctggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcagatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 743 - DNA, 364 bp, Artificial
  MsCOMT deletion introduced by TALEN pair MsCOMT_T01.1
tctcacaaaaacctcatcactcacaaccatgggttcaccaggtgaaactcaaataaccaacccacatatcagatgaagaagcacacctcttcgccatgcaattagcaagtgcttcagttcttcccatgattttaaaatcagctcttgaacttgatctcttagaactcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 744 - DNA, 361 bp, Artificial
  MsCOMT deletion introduced by TALEN pair MsCOMT_T01.1
tctcacaaaaacctcatcaattcacaaccatgggttcaacaggtgaaactcaactaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 745 - DNA, 356 bp, Artificial
  MsCOMT deletion introduced by TALEN pair MsCOMT_T01.1
tctcacaaaaacctcatcaattacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttaagagactttatggtttggatactgttgctaa

SEQ ID NO: 746 - DNA, 312 bp, Artificial
  MsCOMT deletion introduced by TALEN pair MsCOMT_T01.1
tctcacaaaaacctcatcaattacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 747 - DNA, 357 bp, Artificial
  MsCOMT deletion introduced by TALEN pair MsCOMT_T01.1
tctcacaaaaacctcatcaatgaaaaccatgggttcaacaggtgaaactcaaaccgagagatcagatgaagaaggaaagagcgacgccatgcaaatagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 748 - DNA, 345 bp, Artificial
  MsCOMT deletion introduced by TALEN pair MsCOMT_T01.1
tctcacaaaaacctcatcaatctcaaccatgggttcaacaggtgaaactcaagatgaagaagcaaacctcttcgccatgcaattagcaagtgcttcagttcttcccatgattttgaaatcagctcttgaacttgatctcttagaaatcattgctaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 749 - DNA, 357 bp, Artificial
  MsCOMT deletion introduced by TALEN pair MsCOMT_T01.1
tctcacaaaaacctcatcaatctcaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcctgttacaatatcctcacttgttcagttcgtactcaacaagatggaaaggttcagagactttatggtttggctactgttgctaa

SEQ ID NO: 750 - DNA, 364 bp, Artificial
  MsCOMT deletion introduced by TALEN pair MsCOMT_T01.1
tctcacaaaaacctcatcaatctcaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 751 - DNA, 357 bp, Artificial
  MsCOMT deletion introduced by TALEN pair MsCOMT_T01.1
tctcacaaaaacctcatcaatctcaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 752 - DNA, 338 bp, Artificial
  MsCOMT deletion introduced by TALEN pair MsCOMT_T01.1
tctcacaaaaacctcatcaatcccaaccatgggttcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 753 - DNA, 361 bp, Artificial
  MsCOMT deletion introduced by TALEN pair MsCOMT_T01.1
tctcacaaaaacctcatcaatcccaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 754 - DNA, 364 bp, Artificial
  MsCOMT deletion introduced by TALEN pair MsCOMT_T01.1
tctcacaaaaacctcatcaatcccaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 755 - DNA, 361 bp, Artificial
  MsCOMT deletion introduced by TALEN pair MsCOMT_T01.1
tctcacaaaaacctcatcaatcccaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgaggcaccagtcatgttggaccgaatgttgcgtctctgggctagttacaatatcctcacttgttctgttcgtactcaacaagatggaaaagttcagagacagtatggtttggctactgttgctaa

SEQ ID NO: 756 - DNA, 360 bp, Artificial
  MsCOMT deletion introduced by TALEN pair MsCOMT_T01.1
tctcacaaaaacctcatcaatcataaccatgggttcaacaggtgaaactcaaataacccacatatcagatgaagaagcaaacctcttcgccatgcaattagcaagtgctttagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 757 - DNA, 363 bp, Artificial
  MsCOMT deletion introduced by TALEN pair MsCOMT_T01.1
tctcacaaaaacctcatcaatcataaaaatgggttcaacaggtgaaaataaaaaaaaaaaaaaaatataagaggaagaagaaaacctcttcgccatgcaactagcaagtgctttagttcttcacatgattttgaaatcagctcttgaacttgatctcttagaaatcattgctaaagctggacctggtgctctaattgcacctattgaaatttattctcagctaccaacaactaaccctgatgcaccagttatgttggaccgaatgttgcgtctcttgtcttattacaatctcctcacttgttcagttcttactcaacaagatggaaactttccacccctttatggtttggctactgttgctaa

SEQ ID NO: 758 - DNA, 247 bp, Artificial
  MsCOMT deletion introduced by TALEN pair MsCOMT_T01.1
tctcacaaaaacctcatcaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 759 - DNA, 247 bp, Artificial
  MsCOMT deletion introduced by TALEN pair MsCOMT_T01.1
tctcacaaaaacctcatcaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 760 - DNA, 247 bp, Artificial
  MsCOMT deletion introduced by TALEN pair MsCOMT_T01.1
tctcacaaaaacctcatcaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 761 - DNA, 247 bp, Artificial
  MsCOMT deletion introduced by TALEN pair MsCOMT_T01.1
tctcacaaaaacctcatcaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 762 - DNA, 247 bp, Artificial
  MsCOMT deletion introduced by TALEN pair MsCOMT_T01.1
tctcacaaaaacctcatcaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 763 - DNA, 247 bp, Artificial
  MsCOMT deletion introduced by TALEN pair MsCOMT_T01.1
tctcacaaaaacctcatcaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 764 - DNA, 247 bp, Artificial
  MsCOMT deletion introduced by TALEN pair MsCOMT_T01.1
tctcacaaaaacctcatcaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 765 - DNA, 247 bp, Artificial
  MsCOMT deletion introduced by TALEN pair MsCOMT_T01.1
tctcacaaaaacctcatcaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 766 - DNA, 360 bp, Artificial
  MsCOMT deletion introduced by TALEN pair MsCOMT_T01.1
tctcacaaaaacctcatcaatcactaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatcgaaaggttcagagactttatggtttggctactgttgctaa

SEQ ID NO: 767 - DNA, 364 bp, Artificial
  MsCOMT deletion introduced by TALEN pair MsCOMT_T01.1
tctcacaaaaacctcatcaatcactaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 768 - DNA, 337 bp, Artificial
  MsCOMT deletion introduced by TALEN pair MsCOMT_T01.1
tctcacaaaaacctcatcaatcacgaccatgggttcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 769 - DNA, 350 bp, Artificial
  MsCOMT deletion introduced by TALEN pair MsCOMT_T01.1
tctcacaaaaacctcatcaatcacgaccatgggttcaacaggtgaaactcaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 770 - DNA, 345 bp, Artificial
  MsCOMT deletion introduced by TALEN pair MsCOMT_T01.1
tctcacaaaaacctcatcaatcacgaccatgggttcaacaggtgaaactcaagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 771 - DNA, 360 bp, Artificial
  MsCOMT deletion introduced by TALEN pair MsCOMT_T01.1
tctcacaaaaacctcatcaatcacgaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 772 - DNA, 362 bp, Artificial
  MsCOMT deletion introduced by TALEN pair MsCOMT_T01.1
tctcacaaaaacctcatcaatcacgaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctagttgctaa

SEQ ID NO: 773 - DNA, 361 bp, Artificial
  MsCOMT deletion introduced by TALEN pair MsCOMT_T01.1
tctcacaaaaacctcatcaatcacgaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 774 - DNA, 357 bp, Artificial
  MsCOMT deletion introduced by TALEN pair MsCOMT_T01.1
tctcacaaaaacctcatcaatcacgaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 775 - DNA, 360 bp, Artificial
  MsCOMT deletion introduced by TALEN pair MsCOMT_T01.1
tctcacaaaaacctcatcaatcacgaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 776 - DNA, 352 bp, Artificial
  MsCOMT deletion introduced by TALEN pair MsCOMT_T01.1
tctcacaaaaacctcatcaatcacgaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 777 - DNA, 366 bp, Artificial
  MsCOMT deletion introduced by TALEN pair MsCOMT_T01.1
tctcacaaaaacctcatcaatcacccccctgggttcccccggtgcccctcccctcccccccacccacatatcatattaataatcaaccctcttcgccctgcccttcgcccgtgcttccgttcttcccattattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 778 - DNA, 361 bp, Artificial
  MsCOMT deletion introduced by TALEN pair MsCOMT_T01.1
tctcacaaaaacctcatcaatcaccaccatgggttcacccggtgacactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 779 - DNA, 361 bp, Artificial
  MsCOMT deletion introduced by TALEN pair MsCOMT_T01.1
tctcacaaaaacctcatcaatcacatccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 780 - DNA, 360 bp, Artificial
  MsCOMT deletion introduced by TALEN pair MsCOMT_T01.1
tctcacaaaaacctcatcaatcacatccatgggttcaacaggtgaaactcaaataacccacatatcagatgaagaagcaaacctcttcgccatgcaactagcaagtgcttcagttcttcccatgattttgaaatcagctcttgaacttgatctcttagaaatcatggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 781 - DNA, 357 bp, Artificial
  MsCOMT deletion introduced by TALEN pair MsCOMT_T01.1
tctcacaaaaacctcatcaatcacatccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctggttacaatatcctcacttgttcagttagtactcaacaagatggaaagattaagagactttatggtttggctactgttgctaa

SEQ ID NO: 782 - DNA, 360 bp, Artificial
  MsCOMT deletion introduced by TALEN pair MsCOMT_T01.1
tctcacaaaaacctcatcaatcacatccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 783 - DNA, 356 bp, Artificial
  MsCOMT deletion introduced by TALEN pair MsCOMT_T01.1
tctcacaaaaacctcatcaatcacagccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 784 - DNA, 359 bp, Artificial
  MsCOMT deletion introduced by TALEN pair MsCOMT_T01.1
tctcacaaaaacctcatcaatcacagccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 785 - DNA, 358 bp, Artificial
  MsCOMT deletion introduced by TALEN pair MsCOMT_T01.1
tctcacaaaaacctcatcaatcacagccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 786 - DNA, 360 bp, Artificial
  MsCOMT deletion introduced by TALEN pair MsCOMT_T01.1
tctcacaaaaacctcatcaatcacagccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 787 - DNA, 361 bp, Artificial
  MsCOMT deletion introduced by TALEN pair MsCOMT_T01.1
tctcacaaaaacctcatcaatcacagccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 788 - DNA, 361 bp, Artificial
  MsCOMT deletion introduced by TALEN pair MsCOMT_T01.1
tctcacaaaaacctcatcaatcacagccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 789 - DNA, 357 bp, Artificial
  MsCOMT deletion introduced by TALEN pair MsCOMT_T01.1
tctcacaaaaacctcatcaatcacagccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 790 - DNA, 360 bp, Artificial
  MsCOMT deletion introduced by TALEN pair MsCOMT_T01.1
tctcacaaaaacctcatcaatcacagccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 791 - DNA, 353 bp, Artificial
  MsCOMT deletion introduced by TALEN pair MsCOMT_T01.1
tctcacaaaaacctcatcaatcacacccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 792 - DNA, 363 bp, Artificial
  MsCOMT deletion introduced by TALEN pair MsCOMT_T01.1
tctcacaaaaacctcatcaatcacaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 793 - DNA, 354 bp, Artificial
  MsCOMT deletion introduced by TALEN pair MsCOMT_T01.1
tctcacaaaaacctcatcaatcacaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 794 - DNA, 358 bp, Artificial
  MsCOMT deletion introduced by TALEN pair MsCOMT_T01.1
tctcacaaaaacctcatcaatcacaatcatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 795 - DNA, 359 bp, Artificial
  MsCOMT deletion introduced by TALEN pair MsCOMT_T01.1
tctcacaaaaacctcatcaatcacaatcatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 796 - DNA, 360 bp, Artificial
  MsCOMT deletion introduced by TALEN pair MsCOMT_T01.1
tctcacaaaaacctcatcaatcacaatcatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 797 - DNA, 360 bp, Artificial
  MsCOMT deletion introduced by TALEN pair MsCOMT_T01.1
tctcacaaaaacctcatcaatcacaatcatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 798 - DNA, 360 bp, Artificial
  MsCOMT deletion introduced by TALEN pair MsCOMT_T01.1
tctcacaaaaacctcatcaatcacaactatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 799 - DNA, 361 bp, Artificial
  MsCOMT deletion introduced by TALEN pair MsCOMT_T01.1
tctcacaaaaacctcatcaatcacaactatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagctaaccctgatgcaccagttattttggaccgaatgttgcgtctcttggcttgttacaatatcctcacttgttcagttcgtactcaacaagatggaaagattcagagactttatggtttggctactgatgctaa

SEQ ID NO: 800 - DNA, 345 bp, Artificial
  MsCOMT deletion introduced by TALEN pair MsCOMT_T01.1
tctcacaaaaacctcatcaatcacaactatgggttcaacaggtgaaactaaagatgaagaagcaaaccgatgagaaaagcaattagcaagtgcttcagttcttcccatgattttaaaatcagctcttgaacttgatctcttagaaatcattgctaaagctggacctggtgctcaaatttcacctattgaaattgcttctcagctcccatcaactaaccctgatgcaccagttatgttggaccgaatgttgcgtctcttgtcttgtttcaatatcctcactttttcagttcgtactcaacaagatggaaaccttcttccactttatggtttggctactgttgctaa

SEQ ID NO: 801 - DNA, 351 bp, Artificial
  MsCOMT deletion introduced by TALEN pair MsCOMT_T01.1
tctcacaaaaacctcatcaatcacaactatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 802 - DNA, 343 bp, Artificial
  MsCOMT deletion introduced by TALEN pair MsCOMT_T01.1
tctcacaaaaacctcatcaatcacaactatgggttcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 803 - DNA, 356 bp, Artificial
  MsCOMT deletion introduced by TALEN pair MsCOMT_T01.1
tctcacaaaaacctcatcaatcacaaccttgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 804 - DNA, 360 bp, Artificial
  MsCOMT deletion introduced by TALEN pair MsCOMT_T01.1
tctcacaaaaacctcatcaatcacaaccttgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 805 - DNA, 349 bp, Artificial
  MsCOMT deletion introduced by TALEN pair MsCOMT_T01.1
tctcacaaaaacctcatcaatcacaaccgtgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtaatcaacaagatggaaagattcagagactttatggtttggctactgttctaa

SEQ ID NO: 806 - DNA, 356 bp, Artificial
  MsCOMT deletion introduced by TALEN pair MsCOMT_T01.1
tctcacaaaaacctcatcaatcacaaccgtgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 807 - DNA, 363 bp, Artificial
  MsCOMT deletion introduced by TALEN pair MsCOMT_T01.1
tctcacaaaaacctcatcaatcacaaccgtgggttcaacaggtgaaactcaaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 808 - DNA, 361 bp, Artificial
  MsCOMT deletion introduced by TALEN pair MsCOMT_T01.1
tctcacaaaaacctcatcaatcacaaccgtgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 809 - DNA, 361 bp, Artificial
  MsCOMT deletion introduced by TALEN pair MsCOMT_T01.1
tctcacaaaaacctcatcaatcacaaccgtgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 810 - DNA, 312 bp, Artificial
  MsCOMT deletion introduced by TALEN pair MsCOMT_T01.1
tctcacaaaaacctcatcaatcacaaccgcaaacctcttcgccgtgcaactagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 811 - DNA, 427 bp, Artificial
  MsCOMT deletion introduced by TALEN pair MsCOMT_T01.1
tctcacaaaaacctcatcaatcacaaccctgggttcaacaggtgaaactcaaatgcacgacgacatcattccgtggcgctatccagctaagcgcgaactgcaatttggagaatggcagcgcaacccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 812 - DNA, 359 bp, Artificial
  MsCOMT deletion introduced by TALEN pair MsCOMT_T01.1
tctcacaaaaacctcatcaatcacaaccctgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 813 - DNA, 363 bp, Artificial
  MsCOMT deletion introduced by TALEN pair MsCOMT_T01.1
tctcacaaaaacctcatcaatcacaaccctgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 814 - DNA, 361 bp, Artificial
  MsCOMT deletion introduced by TALEN pair MsCOMT_T01.1
tctcacaaaaacctcatcaatcacaaccctgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctgaacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaagattcagagactttatggtttggctactgttgctaa

SEQ ID NO: 815 - DNA, 361 bp, Artificial
  MsCOMT deletion introduced by TALEN pair MsCOMT_T01.1
tctcacaaaaacctcatcaatcacaaccctgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 816 - DNA, 366 bp, Artificial
  MsCOMT deletion introduced by TALEN pair MsCOMT_T01.1
tctcacaaaaacctcatcaatcacaaccctgggttcaacaggtgaaaccccccccccccccccccacatcccctcttcagaagcaaacctcttccccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatgcgcacttgttcagttcgtactcaacaagatggaaagcggaagagactgtatggtttggctactgttgctaa

SEQ ID NO: 817 - DNA, 354 bp, Artificial
  MsCOMT deletion introduced by TALEN pair MsCOMT_T01.1
tctcacaaaaacctcatcaatcacaaccattggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaagttcagagactttatggtttggctactgttgctaa

SEQ ID NO: 818 - DNA, 359 bp, Artificial
  MsCOMT deletion introduced by TALEN pair MsCOMT_T01.1
tctcacaaaaacctcatcaatcacaaccattggttcaacaggtgaaactcaaatacccacatatcagatgaagaagcaaacctcttcgccatgcaactagcaagtgcttcagttcttcccatgattttgaaatcagctcttgaacttgatctcttagaaatcatttctaaagctggacctggtgctcaaatttcacctattgaaattgcttatcagctaccaacaactaaccctgatgcaacagttatgttggaccgaatgttgcgtctcttggcttgttacaatatcctcacttgttcagttcgtactcaacaagagggaaagattcagagactttatggtttggctactgtggctaa

SEQ ID NO: 819 - DNA, 360 bp, Artificial
  MsCOMT deletion introduced by TALEN pair MsCOMT_T01.1
tctcacaaaaacctcatcaatcacaaccattggttcaacaggtgaaactcaaataacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 820 - DNA, 360 bp, Artificial
  MsCOMT deletion introduced by TALEN pair MsCOMT_T01.1
tctcacaaaaacctcatcaatcacaaccattggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 821 - DNA, 360 bp, Artificial
  MsCOMT deletion introduced by TALEN pair MsCOMT_T01.1
tctcacaaaaacctcatcaatcacaaccatgtgttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 822 - DNA, 358 bp, Artificial
  MsCOMT deletion introduced by TALEN pair MsCOMT_T01.1
tctcacaaaaacctcatcaatcacaaccatggtttcacaggtgaaactcaaatacccacatatcagatgaaggagcaaacctcttcccccagcaattaacaagggcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 823 - DNA, 359 bp, Artificial
  MsCOMT deletion introduced by TALEN pair MsCOMT_T01.1
tctcacaaaaacctcatcaatcacaaccatggttcaacaggtgaaactcaaataacccacatatcagatgaagaagcaaacctcttcgccatgcaattagccagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 824 - DNA, 334 bp, Artificial
  MsCOMT deletion introduced by TALEN pair MsCOMT_T01.1
tctcacaaaaacctcatcaatcacaaccatggtacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 825 - DNA, 358 bp, Artificial
  MsCOMT deletion introduced by TALEN pair MsCOMT_T01.1
tctcacaaaaacctcatcaatcacaaccatgggtttaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 826 - DNA, 360 bp, Artificial
  MsCOMT deletion introduced by TALEN pair MsCOMT_T01.1
tctcacaaaaacctcatcaatcacaaccatgggtttaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 827 - DNA, 353 bp, Artificial
  MsCOMT deletion introduced by TALEN pair MsCOMT_T01.1
tctcacaaaaacctcatcaatcacaaccatgggtttaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 828 - DNA, 350 bp, Artificial
  MsCOMT deletion introduced by TALEN pair MsCOMT_T01.1
tctcacaaaaacctcatcaatcacaaccatgggttctacaggtgaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 829 - DNA, 364 bp, Artificial
  MsCOMT deletion introduced by TALEN pair MsCOMT_T01.1
tctcacaaaaacctcatcaatcacaaccatgggttctacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccagcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 830 - DNA, 357 bp, Artificial
  MsCOMT deletion introduced by TALEN pair MsCOMT_T01.1
tctcacaaaaacctcatcaatcacaaccatgggttctacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 831 - DNA, 358 bp, Artificial
  MsCOMT deletion introduced by TALEN pair MsCOMT_T01.1
tctcacaaaaacctcatcaatcacaaccatgggttctacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 832 - DNA, 351 bp, Artificial
  MsCOMT deletion introduced by TALEN pair MsCOMT_T01.1
tctcacaaaaacctcatcaatcacaaccatgggttctacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 833 - DNA, 356 bp, Artificial
  MsCOMT deletion introduced by TALEN pair MsCOMT_T01.1
tctcacaaaaacctcatcaatcacaaccatgggttcgacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcgaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 834 - DNA, 359 bp, Artificial
  MsCOMT deletion introduced by TALEN pair MsCOMT_T01.1
tctcacaaaaacctcatcaatcacaaccatgggttcgacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 835 - DNA, 358 bp, Artificial
  MsCOMT deletion introduced by TALEN pair MsCOMT_T01.1
tctcacaaaaacctcatcaatcacaaccatgggttcgacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 836 - DNA, 360 bp, Artificial
  MsCOMT deletion introduced by TALEN pair MsCOMT_T01.1
tctcacaaaaacctcatcaatcacaaccatgggttcgacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcaattcgtactcaacaagatggaaaggttcagagactttatggtttggctactgttgctaa

SEQ ID NO: 837 - DNA, 360 bp, Artificial
  MsCOMT deletion introduced by TALEN pair MsCOMT_T01.1
tctcacaaaaacctcatcaatcacaaccatgggttcgacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 838 - DNA, 361 bp, Artificial
  MsCOMT deletion introduced by TALEN pair MsCOMT_T01.1
tctcacaaaaacctcatcaatcacaaccatgggttcgacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcatagactttatggtttggctactgttgctaa

SEQ ID NO: 839 - DNA, 358 bp, Artificial
  MsCOMT deletion introduced by TALEN pair MsCOMT_T01.1
tctcacaaaaacctcatcaatcacaaccatgggttcgacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 840 - DNA, 358 bp, Artificial
  MsCOMT deletion introduced by TALEN pair MsCOMT_T01.1
tctcacaaaaacctcatcaatcacaaccatgggttcgacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 841 - DNA, 360 bp, Artificial
  MsCOMT deletion introduced by TALEN pair MsCOMT_T01.1
tctcacaaaaacctcatcaatcacaaccatgggttcatcaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 842 - DNA, 358 bp, Artificial
  MsCOMT deletion introduced by TALEN pair MsCOMT_T01.1
tctcacaaaaacctcatcaatcacaaccatgggttcagcaggtgaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 843 - DNA, 358 bp, Artificial
  MsCOMT deletion introduced by TALEN pair MsCOMT_T01.1
tctcacaaaaacctcatcaatcacaaccatgggttcagcaggtgaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 844 - DNA, 360 bp, Artificial
  MsCOMT deletion introduced by TALEN pair MsCOMT_T01.1
tctcacaaaaacctcatcaatcacaaccatgggttcagcaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 845 - DNA, 360 bp, Artificial
  MsCOMT deletion introduced by TALEN pair MsCOMT_T01.1
tctcacaaaaacctcatcaatcacaaccatgggttcagcaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 846 - DNA, 360 bp, Artificial
  MsCOMT deletion introduced by TALEN pair MsCOMT_T01.1
tctcacaaaaacctcatcaatcacaaccatgggttcagcaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 847 - DNA, 364 bp, Artificial
  MsCOMT deletion introduced by TALEN pair MsCOMT_T01.1
tctcacaaaaacctcatcaatcacaaccatgggttcagcaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 848 - DNA, 362 bp, Artificial
  MsCOMT deletion introduced by TALEN pair MsCOMT_T01.1
tctcacaaaaacctcatcaatcacaaccatgggttcagcaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 849 - DNA, 358 bp, Artificial
  MsCOMT deletion introduced by TALEN pair MsCOMT_T01.1
tctcacaaaaacctcatcaatcacaaccatgggttcagcaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 850 - DNA, 347 bp, Artificial
  MsCOMT deletion introduced by TALEN pair MsCOMT_T01.1
tctcacaaaaacctcatcaatcacaaccatgggttcagcacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 851 - DNA, 363 bp, Artificial
  MsCOMT deletion introduced by TALEN pair MsCOMT_T01.1
tctcacaaaaacctcatcaatcacaaccatgggttcaccgggggaactccaaaaaccaacccaaatatcagatgaaaaagcacaccccttcgccatgcaaccagcaaaggcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 852 - DNA, 360 bp, Artificial
  MsCOMT deletion introduced by TALEN pair MsCOMT_T01.1
tctcacaaaaacctcatcaatcacaaccatgggttcaccaggtgaaactcaactaacccacatatccgatgaagaagcaaacctcttcgccatgcaactagcacgtgcttcagttcttcccatgattttgaaatcagctcttgaacttgatctcttagaaatcattgctaaatctgtacctgttgctcaaatttcacctattgaaattgcttctcagctaccaacaactaaccctgatgcaccatttatgttggaccgaatattgcatctctgggcttgttacaatatccacactggttcagttcttactcaacaatatggaaaggttcagagcctttatggtttgtctacttttgctaa

SEQ ID NO: 853 - DNA, 362 bp, Artificial
  MsCOMT deletion introduced by TALEN pair MsCOMT_T01.1
tctcacaaaaacctcatcaatcacaaccatgggttcaccaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 854 - DNA, 362 bp, Artificial
  MsCOMT deletion introduced by TALEN pair MsCOMT_T01.1
tctcacaaaaacctcatcaatcacaaccatgggttcaccaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 855 - DNA, 357 bp, Artificial
  MsCOMT deletion introduced by TALEN pair MsCOMT_T01.1
tctcacaaaaacctcatcaatcacaaccatgggttcaccaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 856 - DNA, 337 bp, Artificial
  MsCOMT deletion introduced by TALEN pair MsCOMT_T01.1
tctcacaaaaacctcatcaatcacaaccatgggttcacatatcagatgaggaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 857 - DNA, 337 bp, Artificial
  MsCOMT deletion introduced by TALEN pair MsCOMT_T01.1
tctcacaaaaacctcatcaatcacaaccatgggttcacatatcagatgacgaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 858 - DNA, 337 bp, Artificial
  MsCOMT deletion introduced by TALEN pair MsCOMT_T01.1
tctcacaaaaacctcatcaatcacaaccatgggttcacatatcagatgacgaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 859 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 860 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 861 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 862 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcgactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 863 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 864 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 865 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 866 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 867 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 868 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 869 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 870 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 871 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactggcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 872 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 873 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttccgttcttcccatgattttgaaatcagctcttgaacttgatctcttagaaatcattgctaaagctggacctagtgctcaaatttcacctattgaaatttcttctcagctcccaacaactaaccctgatgcaccagttacgttggaccgaatgttgcgtctcttgggttgttacaatatcctcacttgttcagttcgtactcaacaagatggaaagattcagagactttatggtttggctactgtagctaa

SEQ ID NO: 874 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttggacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 875 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 876 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 877 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 878 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 879 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 880 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 881 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 882 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 883 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 884 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 885 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 886 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 887 - DNA, 336 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 888 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 889 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 890 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttggtacaatatcctcacttgttcagttcgtactcaacaagatggaaagattcagagactttatggtttggctactgttgctaa

SEQ ID NO: 891 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 892 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 893 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 894 - DNA, 336 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggcactgttgctaa

SEQ ID NO: 895 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaagttgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 896 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 897 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 898 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 899 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 900 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 901 - DNA, 337 bp, Artificial
  MsCOMT deletion introduced by TALEN pair MsCOMT_T01.1
tctcacaaaaacctcatcaatcacaaccatgggttcacatatcagatgaagaagcaaacctattcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 902 - DNA, 356 bp, Artificial
  MsCOMT deletion introduced by TALEN pair MsCOMT_T01.1
tctcacaaaaacctcatcaatcacaaccatgggttcacaggttaaactcaaacccccaatacagatgaagaaacaaaccccttcgcccagccaatagcaagtgcctcagtttttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 903 - DNA, 360 bp, Artificial
  MsCOMT deletion introduced by TALEN pair MsCOMT_T01.1
tctcacaaaaacctcatcaatcacaaccatgggttcacaggtgaaactcaaataaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 904 - DNA, 345 bp, Artificial
  MsCOMT deletion introduced by TALEN pair MsCOMT_T01.1
tctcacaaaaacctcatcaatcacaaccatgggttcaataggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 905 - DNA, 361 bp, Artificial
  MsCOMT deletion introduced by TALEN pair MsCOMT_T01.1
tctcacaaaaacctcatcaatcacaaccatgggttcaataggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttgtaccgaatgttgcgtctcttggcttgttacaatatcctcacttgttctgttcgtactcaacaagattgaaaggttcagagactttatggttttgctactgttgctaa

SEQ ID NO: 906 - DNA, 359 bp, Artificial
  MsCOMT deletion introduced by TALEN pair MsCOMT_T01.1
tctcacaaaaacctcatcaatcacaaccatgggttcaataggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 907 - DNA, 359 bp, Artificial
  MsCOMT deletion introduced by TALEN pair MsCOMT_T01.1
tctcacaaaaacctcatcaatcacaaccatgggttcaataggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 908 - DNA, 359 bp, Artificial
  MsCOMT deletion introduced by TALEN pair MsCOMT_T01.1
tctcacaaaaacctcatcaatcacaaccatgggttcaataggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 909 - DNA, 359 bp, Artificial
  MsCOMT deletion introduced by TALEN pair MsCOMT_T01.1
tctcacaaaaacctcatcaatcacaaccatgggttcaataggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 910 - DNA, 359 bp, Artificial
  MsCOMT deletion introduced by TALEN pair MsCOMT_T01.1
tctcacaaaaacctcatcaatcacaaccatgggttcaataggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 911 - DNA, 359 bp, Artificial
  MsCOMT deletion introduced by TALEN pair MsCOMT_T01.1
tctcacaaaaacctcatcaatcacaaccatgggttcaataggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 912 - DNA, 360 bp, Artificial
  MsCOMT deletion introduced by TALEN pair MsCOMT_T01.1
tctcacaaaaacctcatcaatcacaaccatgggttcaataggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 913 - DNA, 364 bp, Artificial
  MsCOMT deletion introduced by TALEN pair MsCOMT_T01.1
tctcacaaaaacctcatcaatcacaaccatgggttcaataggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 914 - DNA, 357 bp, Artificial
  MsCOMT deletion introduced by TALEN pair MsCOMT_T01.1
tctcacaaaaacctcatcaatcacaaccatgggttcaataggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 915 - DNA, 357 bp, Artificial
  MsCOMT deletion introduced by TALEN pair MsCOMT_T01.1
tctcacaaaaacctcatcaatcacaaccatgggttcaataggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 916 - DNA, 356 bp, Artificial
  MsCOMT deletion introduced by TALEN pair MsCOMT_T01.1
tctcacaaaaacctcatcaatcacaaccatgggttcaactggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 917 - DNA, 360 bp, Artificial
  MsCOMT deletion introduced by TALEN pair MsCOMT_T01.1
tctcacaaaaacctcatcaatcacaaccatgggttcaactggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 918 - DNA, 360 bp, Artificial
  MsCOMT deletion introduced by TALEN pair MsCOMT_T01.1
tctcacaaaaacctcatcaatcacaaccatgggttcaactggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 919 - DNA, 361 bp, Artificial
  MsCOMT deletion introduced by TALEN pair MsCOMT_T01.1
tctcacaaaaacctcatcaatcacaaccatgggttcaactggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 920 - DNA, 362 bp, Artificial
  MsCOMT deletion introduced by TALEN pair MsCOMT_T01.1
tctcacaaaaacctcatcaatcacaaccatgggttcaactggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgtaccgaatgttgcgtctcttggcttgttacaatatcctcacttgttcagttcgtactcaacatgatggaaagattcagagactttatggtttggctactgttgctaa

SEQ ID NO: 921 - DNA, 356 bp, Artificial
  MsCOMT deletion introduced by TALEN pair MsCOMT_T01.1
tctcacaaaaacctcatcaatcacaaccatgggttcaacgggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 922 - DNA, 355 bp, Artificial
  MsCOMT deletion introduced by TALEN pair MsCOMT_T01.1
tctcacaaaaacctcatcaatcacaaccatgggttcaacgggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 923 - DNA, 358 bp, Artificial
  MsCOMT deletion introduced by TALEN pair MsCOMT_T01.1
tctcacaaaaacctcatcaatcacaaccatgggttcaacgggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 924 - DNA, 359 bp, Artificial
  MsCOMT deletion introduced by TALEN pair MsCOMT_T01.1
tctcacaaaaacctcatcaatcacaaccatgggttcaacgggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 925 - DNA, 359 bp, Artificial
  MsCOMT deletion introduced by TALEN pair MsCOMT_T01.1
tctcacaaaaacctcatcaatcacaaccatgggttcaacgggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 926 - DNA, 360 bp, Artificial
  MsCOMT deletion introduced by TALEN pair MsCOMT_T01.1
tctcacaaaaacctcatcaatcacaaccatgggttcaacgggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 927 - DNA, 360 bp, Artificial
  MsCOMT deletion introduced by TALEN pair MsCOMT_T01.1
tctcacaaaaacctcatcaatcacaaccatgggttcaacgggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 928 - DNA, 360 bp, Artificial
  MsCOMT deletion introduced by TALEN pair MsCOMT_T01.1
tctcacaaaaacctcatcaatcacaaccatgggttcaacgggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctaatgatattgcttctcagctcccaacaactaaccctgatgcaccagttatgttggaccgaatgttgcgtctcttggcttgttacaatatcctcacttgttcagttcgtactcaacaagatggaaagattcagagactttctggtttggctactgttgctaa

SEQ ID NO: 929 - DNA, 360 bp, Artificial
  MsCOMT deletion introduced by TALEN pair MsCOMT_T01.1
tctcacaaaaacctcatcaatcacaaccatgggttcaacgggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 930 - DNA, 396 bp, Artificial
  MsCOMT deletion introduced by TALEN pair MsCOMT_T01.1
tctcacaaaaacctcatcaatcacaaccatgggttcaacgggtgaaactcaaataacagcaccggcaacagcgcctgcaccgtctccaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 931 - DNA, 362 bp, Artificial
  MsCOMT deletion introduced by TALEN pair MsCOMT_T01.1
tctcacaaaaacctcatcaatcacaaccatgggttcaacgggtgaaactcaaataacaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacttgctaa

SEQ ID NO: 932 - DNA, 361 bp, Artificial
  MsCOMT deletion introduced by TALEN pair MsCOMT_T01.1
tctcacaaaaacctcatcaatcacaaccatgggttcaacgggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 933 - DNA, 352 bp, Artificial
  MsCOMT deletion introduced by TALEN pair MsCOMT_T01.1
tctcacaaaaacctcatcaatcacaaccatgggttcaacgggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 934 - DNA, 427 bp, Artificial
  MsCOMT deletion introduced by TALEN pair MsCOMT_T01.1
tctcacaaaaacctcatcaatcacaaccatgggttcaaccggtgaaactcaaatgcacgacgacatcattccgtggcgttatccagctaagcgcgaactgcaatttggagaatggcagcgcaacccacatatcagatgaagaagcaaacctcttcgccatgcaattagcaagtgcttcagttcttcccatgattttaaaatcaactcttgaacttgatctcttagaaatcattgctaaagctggacctggtgctcaaatttcacctattgaaattgcttctcagctcccaacaactaaccctgatgcaacagttatgttggaccgaatgttgcgtctcttggcttgttacaatatcctcacttgttcagttcgtactcaacaagatggaaagattcagagactttatggtttggctactgttgctaa

SEQ ID NO: 935 - DNA, 351 bp, Artificial
  MsCOMT deletion introduced by TALEN pair MsCOMT_T01.1
tctcacaaaaacctcatcaatcacaaccatgggttcaaccggtgaaacccacatatcagatgaagaagcaaacctcttcgccatacaattagcaagttcttcagttcttcccatgattttaaaatcagctcttgaacttgatctcttagaaatcattgctaaagctggacctggtgctcaaatttcgcctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 936 - DNA, 342 bp, Artificial
  MsCOMT deletion introduced by TALEN pair MsCOMT_T01.1
tctcacaaaaacctcatcaatcacaaccatgggttcaaccgacatatcagatgaagaaccaaacctcatagccattcaagtagcaagtgcctcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 937 - DNA, 342 bp, Artificial
  MsCOMT deletion introduced by TALEN pair MsCOMT_T01.1
tctcacaaaaacctcatcaatcacaaccatgggttcaacccacatatcagatgtagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 938 - DNA, 342 bp, Artificial
  MsCOMT deletion introduced by TALEN pair MsCOMT_T01.1
tctcacaaaaacctcatcaatcacaaccatgggttcaacccacatatcagatgcagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 939 - DNA, 342 bp, Artificial
  MsCOMT deletion introduced by TALEN pair MsCOMT_T01.1
tctcacaaaaacctcatcaatcacaaccatgggttcaacccacatatcagatgcagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 940 - DNA, 342 bp, Artificial
  MsCOMT deletion introduced by TALEN pair MsCOMT_T01.1
tctcacaaaaacctcatcaatcacaaccatgggttcaacccacatatcagatgcagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaactcccaacaactaaccctgatgcaccagttatgttggaccgaatgttgcgtctcttggcttgttacaatatcctcacttgttcagttcgtactcaacaagatggaaaaattcagagactttatggtttggctactgttgctaa

SEQ ID NO: 941 - DNA, 342 bp, Artificial
  MsCOMT deletion introduced by TALEN pair MsCOMT_T01.1
tctcacaaaaacctcatcaatcacaaccatgggttcaacccacatatcagatgcagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 942 - DNA, 342 bp, Artificial
  MsCOMT deletion introduced by TALEN pair MsCOMT_T01.1
tctcacaaaaacctcatcaatcacaaccatgggttcaacccacatatcagatgcagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 943 - DNA, 342 bp, Artificial
  MsCOMT deletion introduced by TALEN pair MsCOMT_T01.1
tctcacaaaaacctcatcaatcacaaccatgggttcaacccacatatcagatgcagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 944 - DNA, 342 bp, Artificial
  MsCOMT deletion introduced by TALEN pair MsCOMT_T01.1
tctcacaaaaacctcatcaatcacaaccatgggttcaacccacatatcagatgcagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 945 - DNA, 342 bp, Artificial
  MsCOMT deletion introduced by TALEN pair MsCOMT_T01.1
tctcacaaaaacctcatcaatcacaaccatgggttcaacccacatatcagatgaagaatcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 946 - DNA, 342 bp, Artificial
  MsCOMT deletion introduced by TALEN pair MsCOMT_T01.1
tctcacaaaaacctcatcaatcacaaccatgggttcaacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 947 - DNA, 342 bp, Artificial
  MsCOMT deletion introduced by TALEN pair MsCOMT_T01.1
tctcacaaaaacctcatcaatcacaaccatgggttcaacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 948 - DNA, 342 bp, Artificial
  MsCOMT deletion introduced by TALEN pair MsCOMT_T01.1
tctcacaaaaacctcatcaatcacaaccatgggttcaacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 949 - DNA, 342 bp, Artificial
  MsCOMT deletion introduced by TALEN pair MsCOMT_T01.1
tctcacaaaaacctcatcaatcacaaccatgggttcaacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 950 - DNA, 342 bp, Artificial
  MsCOMT deletion introduced by TALEN pair MsCOMT_T01.1
tctcacaaaaacctcatcaatcacaaccatgggttcaacccacatatcagatgaagaatcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 951 - DNA, 342 bp, Artificial
  MsCOMT deletion introduced by TALEN pair MsCOMT_T01.1
tctcacaaaaacctcatcaatcacaaccatgggttcaacccacatatcagatgaagaatcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 952 - DNA, 342 bp, Artificial
  MsCOMT deletion introduced by TALEN pair MsCOMT_T01.1
tctcacaaaaacctcatcaatcacaaccatgggttcaacccacatatcagatgaagaatcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 953 - DNA, 342 bp, Artificial
  MsCOMT deletion introduced by TALEN pair MsCOMT_T01.1
tctcacaaaaacctcatcaatcacaaccatgggttcaacccacatatcagatgaagaatcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 954 - DNA, 342 bp, Artificial
  MsCOMT deletion introduced by TALEN pair MsCOMT_T01.1
tctcacaaaaacctcatcaatcacaaccatgggttcaacccacatatcagatgaagaatcaaacctcttcgccatgcaactagcaagtgcttcagttcttcccatgactttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 955 - DNA, 342 bp, Artificial
  MsCOMT deletion introduced by TALEN pair MsCOMT_T01.1
tctcacaaaaacctcatcaatcacaaccatgggttcaacccacatatcagatgaagaagcatacctcttcgccatgcaattagcaagtgcttcagttcttcccatgattttaaaatcagctcttgaacttgatctcttagaaatcattgctaaagctggacctggtgctcaaattttacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 956 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttctccatgcaattagcaagtgcttcagttcttcccatgattttaaaatcagctcttgaacttgatctcttagaaatcattgctaaagctggacctggtgctcaaatttcacctattgaaattgctgctcacctcccaacaactaaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 957 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 958 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcgactagcaagtgcttcagttcttcccatgattttaaaatcagctcttgaacttgatctcttagaaatcattgctaaagctggacctggtgctcaaatttcacctatggaaattgcatctcagctcccaacaactaaccctgatgcaccagttatgttgcaccgaatgttgcgtctcttggcttgttacaatatcctcacttgttcagttcggactcaccaagatggaaaggttcagagactatatggtttggctactgttgctaa

SEQ ID NO: 959 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 960 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 961 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 962 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 963 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 964 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 965 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatgaaaaagttcagagactttatggtttggctactgttgctaa

SEQ ID NO: 966 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 967 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctctttaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaagattcagagactttatggtttggctactgttgctaa

SEQ ID NO: 968 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 969 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 970 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 971 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 972 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 973 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaagattcagagactttatggtttggctactgttgctaa

SEQ ID NO: 974 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 975 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 976 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgacgcaccagttatgttggaccgaatgttgcgtctcttggcttgttacaatatcctcacttgttcagttcgtactcaacaagatggaaaggttcagagactttatggtttggctactgttgctaa

SEQ ID NO: 977 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 978 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 979 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 980 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 981 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 982 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 983 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttgtgttggaccgaatgttgcgtctcttggcttgttacaatatcctcacttgttcagttcgtactcaacaagatggaaaggttcagagactttatggtttggctactgttgctaa

SEQ ID NO: 984 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 985 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 986 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 987 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 988 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 989 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 990 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 991 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 992 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 993 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 994 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 995 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 996 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 997 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 998 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 999 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1000 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1001 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1002 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgatttcgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1003 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttcccatgatttcgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 1004 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagttcttccaatgattttgaaatcagctcttgaacttgatctcttagaactcattgctaaagctggacctggtgctcaaatttcacctattgaaattgcttctcagctaccaacaactaaccctgatgcaccagttatgttggaccgaatgttgcggctcttggcttggtacaatatcctcacttgttcagttcgtacgcaacaagatggaaaggttcagagactttatggtttggctactgttgctaa

SEQ ID NO: 1005 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatgcaactagcaagtgcttcagatcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1006 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaacctcttcgccatacaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1007 - DNA, 342 bp, Artificial
  MsCOMT deletion introduced by TALEN pair MsCOMT_T01.1
tctcacaaaaacctcatcaatcacaaccatgggttcaacccacatatcagatgaagaagcaaaactcttagaaatgtaactagcaagtgcttcagttcttcccatgattttgaaatcagctcttgaacttgatctcttagaaatcattgctaaagctggacctggtgctcacatttcacctattgaaattgcttctcagcttccatcaactaaccctgatgcaccattcatgttggaccgcatgttgcgtctcttaacttgccccaagaaccgcacgggggcaggccgtactcaacaagatggaaaatttccccctctttatggtttggctactgttgctaa

SEQ ID NO: 1008 - DNA, 342 bp, Artificial
  MsCOMT deletion introduced by TALEN pair MsCOMT_T01.1
tctcacaaaaacctcatcaatcacaaccatgggttcaacccacatatcagatgaagaaacaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1009 - DNA, 342 bp, Artificial
  MsCOMT deletion introduced by TALEN pair MsCOMT_T01.1
tctcacaaaaacctcatcaatcacaaccatgggttcaacccacatagcagatgaaaaagcaaacctcttctccatgcaattagcaagtgcttcagttcttcccatgatttgaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1010 - DNA, 346 bp, Artificial
  MsCOMT deletion introduced by TALEN pair MsCOMT_T01.1
tctcacaaaaacctcatcaatcacaaccatgggttcaaccaacccacatctcagatgaagaagcaaacctcttcgccatgcacctagcaagtgcttcagttcttcccatgattttgaaatcagctcttgaacttgatctcttagaagtcattgctaaagctggacctggttctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1011 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacttagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1012 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacttagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1013 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1014 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1015 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1016 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacttaacaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1017 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1018 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 1019 - DNA, 347 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgggctactgttgctaa

SEQ ID NO: 1020 - DNA, 345 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggtactgttgctaa

SEQ ID NO: 1021 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1022 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1023 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaattagccagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1024 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1025 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1026 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1027 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1028 - DNA, 341 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcttgctaa

SEQ ID NO: 1029 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1030 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1031 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1032 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagccagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1033 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagccagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1034 - DNA, 345 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagccagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctacgttgctaa

SEQ ID NO: 1035 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1036 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1037 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1038 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1039 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1040 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggtccgaatgttgcgtctcttggcttgttacaatatcctcacttgttcagttcgtactcaacaagatggaaagattcagagactttatggtttggctactgttgctaa

SEQ ID NO: 1041 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1042 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1043 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1044 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1045 - DNA, 345 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattaaaattgcttctcagctccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1046 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1047 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1048 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttatcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1049 - DNA, 346 bp, Artificial
  MsCOMT deletion introduced by TALEN pair MsCOMT_T01.1
tctcacaaaaacctcatcaatcacaaccatgggttcaaccaacccacatatcagatgaagaagcaaacctcttcgccatgcaactagcaagtgcttcagttcttcccatgattgtgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1050 - DNA, 360 bp, Artificial
  MsCOMT deletion introduced by TALEN pair MsCOMT_T01.1
tctcacaaaaacctcatcaatcacaaccatgggttcaacatgtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1051 - DNA, 361 bp, Artificial
  MsCOMT deletion introduced by TALEN pair MsCOMT_T01.1
tctcacaaaaacctcatcaatcacaaccatgggttcaacatgtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1052 - DNA, 352 bp, Artificial
  MsCOMT deletion introduced by TALEN pair MsCOMT_T01.1
tctcacaaaaacctcatcaatcacaaccatgggttcaacatgtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1053 - DNA, 338 bp, Artificial
  MsCOMT deletion introduced by TALEN pair MsCOMT_T01.1
tctcacaaaaacctcatcaatcacaaccatgggttcaacatatcagatgcagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1054 - DNA, 338 bp, Artificial
  MsCOMT deletion introduced by TALEN pair MsCOMT_T01.1
tctcacaaaaacctcatcaatcacaaccatgggttcaacatatcagatgaagacgcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1055 - DNA, 338 bp, Artificial
  MsCOMT deletion introduced by TALEN pair MsCOMT_T01.1
tctcacaaaaacctcatcaatcacaaccatgggttcaacatatcagatgaagacgcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1056 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaattagcaagtgcttccgttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1057 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1058 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1059 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1060 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1061 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1062 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1063 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1064 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1065 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1066 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 1067 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1068 - DNA, 338 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1069 - DNA, 337 bp, Artificial
  MsCOMT deletion introduced by TALEN pair MsCOMT_T01.1
tctcacaaaaacctcatcaatcacaaccatgggttcaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 1070 - DNA, 356 bp, Artificial
  MsCOMT deletion introduced by TALEN pair MsCOMT_T01.1
tctcacaaaaacctcatcaatcacaaccatgggttcaacagttgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1071 - DNA, 352 bp, Artificial
  MsCOMT deletion introduced by TALEN pair MsCOMT_T01.1
tctcacaaaaacctcatcaatcacaaccatgggttcaacaggttgacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcgcagctcccaacaactaaccctgatgcaccagttatgttggaccgaatgttgcgtctcgtggcttgttacaatatcctcacttgttcagttcgtactcaacaagatggaaagattcagagactttatggtttggctactgttgctaa

SEQ ID NO: 1072 - DNA, 352 bp, Artificial
  MsCOMT deletion introduced by TALEN pair MsCOMT_T01.1
tctcacaaaaacctcatcaatcacaaccatgggttcaacaggttgaaacccacctatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1073 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1074 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1075 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1076 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatgggttggctactgttgctaa

SEQ ID NO: 1077 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1078 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1079 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1080 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1081 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1082 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1083 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1084 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1085 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1086 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1087 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1088 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1089 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1090 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctggttacaatatcctcacttgttcaggtcgtactcaacaagatggaaaggttcagagactttatggtttggctactgttgctaa

SEQ ID NO: 1091 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1092 - DNA, 351 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 1093 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 1094 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1095 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1096 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaattagcaagtacttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaaggttcagagactttatggtttagctactgttgctaa

SEQ ID NO: 1097 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1098 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagttcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1099 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttgaaatcagctcttgaacttgatctcttagaaatcattgctaaagctggagctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttattgtttggctactgttgctaa

SEQ ID NO: 1100 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 1101 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 1102 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1103 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatattgcgtctcttggcttgttacaatatcctcacttgttcagttcgtactcaacaagatggaaagattcagagactttatggtttggctactgttgctaa

SEQ ID NO: 1104 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1105 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1106 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagttggaaaggttcagagactttatggtttggctactgttgctaa

SEQ ID NO: 1107 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttattcagttcgtactcaacaagatggaaaggttcagagactttatggtttggctactgttgctaa

SEQ ID NO: 1108 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1109 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1110 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1111 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1112 - DNA, 352 bp, Artificial
  MsCOMT deletion introduced by TALEN pair MsCOMT_T01.1
tctcacaaaaacctcatcaatcacaaccatgggttcaacaggttgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1113 - DNA, 359 bp, Artificial
  MsCOMT deletion introduced by TALEN pair MsCOMT_T01.1
tctcacaaaaacctcatcaatcacaaccatgggttcaacaggttaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1114 - DNA, 359 bp, Artificial
  MsCOMT deletion introduced by TALEN pair MsCOMT_T01.1
tctcacaaaaacctcatcaatcacaaccatgggttcaacaggttaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1115 - DNA, 358 bp, Artificial
  MsCOMT deletion introduced by TALEN pair MsCOMT_T01.1
tctcacaaaaacctcatcaatcacaaccatgggttcaacaggttaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1116 - DNA, 461 bp, Artificial
  MsCOMT deletion introduced by TALEN pair MsCOMT_T01.1
tctcacaaaaacctcatcaatcacaaccatgggttcaacaggtgttgcccttgcagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1117 - DNA, 461 bp, Artificial
  MsCOMT deletion introduced by TALEN pair MsCOMT_T01.1
tctcacaaaaacctcatcaatcacaaccatgggttcaacaggtgttgcccttgcagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1118 - DNA, 461 bp, Artificial
  MsCOMT deletion introduced by TALEN pair MsCOMT_T01.1
tctcacaaaaacctcatcaatcacaaccatgggttcaacaggtgttgcccttgaagtgtccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1119 - DNA, 461 bp, Artificial
  MsCOMT deletion introduced by TALEN pair MsCOMT_T01.1
tctcacaaaaacctcatcaatcacaaccatgggttcaacaggtgttgcccttgaagtgtccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1120 - DNA, 461 bp, Artificial
  MsCOMT deletion introduced by TALEN pair MsCOMT_T01.1
tctcacaaaaacctcatcaatcacaaccatgggttcaacaggtgttgcccttgaagtgtccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctattagaaatcattgctaaagctggacctggtgctaaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1121 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggatgggtacaccttccaccactcgttggggttgatgtgcttgttcctggtctggttcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1122 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggatgggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1123 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggatgggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1124 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggatgggtacaccttccaccactcgttggggttgatgtgcttgttcctggtctggttcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1125 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcaactaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1126 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1127 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1128 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1129 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1130 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1131 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1132 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1133 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctactgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1134 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcatagaaatcattgctaaagctagacctggtgctcaaattgcacataatgaaattgcttcacagctaccaacaactcaccctgatgcaccaattatgttggaccgaatgttgcgtctcttggcttgttacaatatcctcacttgttcagttcgtactcaacaagatggaaaggttcacagactttatggtttggctactgttgctaa

SEQ ID NO: 1135 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1136 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1137 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatctcttagaaatcatggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1138 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaattagcaagtgcttcagttcttcccatgattttaaaatcagctcttgaacttgatcccttagaaatcattgctaaagctggacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 1139 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1140 - DNA, 461 bp, Artificial
  MsCOMT deletion introduced by TALEN pair MsCOMT_T01.1
tctcacaaaaacctcatcaatcacaaccatgggttcaacaggtgttgcccttgaagtggccggacacgaacaggaacttgaactcggtcacgctggaggggtacaccttccaccactcgttggggttgatgtgcttgttcctggtctggttcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1141 - DNA, 461 bp, Artificial
  MsCOMT deletion introduced by TALEN pair MsCOMT_T01.1
tctcacaaaaacctcatcaatcacaaccatgggttcaacaggtgttgcccttgaagtgcccggacacgaacaggaacttgaactcggtcacgctggaggggtacaccttccagcactcgttggggttgatgtgcttgttcctggtctggttcaccaacccacatatcagatgaagaagcaaacctcttcgccatgcaattagcaagtgcttcagttcttcccatgaatttaaaatcacctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1142 - DNA, 345 bp, Artificial
  MsCOMT deletion introduced by TALEN pair MsCOMT_T01.1
tctcacaaaaacctcatcaatcacaaccatgggttcaacaggtgtaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1143 - DNA, 359 bp, Artificial
  MsCOMT deletion introduced by TALEN pair MsCOMT_T01.1
tctcacaaaaacctcatcaatcacaaccatgggttcaacaggtgtaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1144 - DNA, 361 bp, Artificial
  MsCOMT deletion introduced by TALEN pair MsCOMT_T01.1
tctcacaaaaacctcatcaatcacaaccatgggttcaacaggtgtaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1145 - DNA, 359 bp, Artificial
  MsCOMT deletion introduced by TALEN pair MsCOMT_T01.1
tctcacaaaaacctcatcaatcacaaccatgggttcaacaggtggaactcaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1146 - DNA, 359 bp, Artificial
  MsCOMT deletion introduced by TALEN pair MsCOMT_T01.1
tctcacaaaaacctcatcaatcacaaccatgggttcaacaggtggaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1147 - DNA, 360 bp, Artificial
  MsCOMT deletion introduced by TALEN pair MsCOMT_T01.1
tctcacaaaaacctcatcaatcacaaccatgggttcaacaggtggaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1148 - DNA, 360 bp, Artificial
  MsCOMT deletion introduced by TALEN pair MsCOMT_T01.1
tctcacaaaaacctcatcaatcacaaccatgggttcaacaggtggaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1149 - DNA, 364 bp, Artificial
  MsCOMT deletion introduced by TALEN pair MsCOMT_T01.1
tctcacaaaaacctcatcaatcacaaccatgggttcaacaggtggaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1150 - DNA, 361 bp, Artificial
  MsCOMT deletion introduced by TALEN pair MsCOMT_T01.1
tctcacaaaaacctcatcaatcacaaccatgggttcaacaggtggaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1151 - DNA, 361 bp, Artificial
  MsCOMT deletion introduced by TALEN pair MsCOMT_T01.1
tctcacaaaaacctcatcaatcacaaccatgggttcaacaggtgatactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1152 - DNA, 360 bp, Artificial
  MsCOMT deletion introduced by TALEN pair MsCOMT_T01.1
tctcacaaaaacctcatcaatcacaaccatgggttcaacaggtgagactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1153 - DNA, 364 bp, Artificial
  MsCOMT deletion introduced by TALEN pair MsCOMT_T01.1
tctcacaaaaacctcatcaatcacaaccatgggttcaacaggtgagactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1154 - DNA, 361 bp, Artificial
  MsCOMT deletion introduced by TALEN pair MsCOMT_T01.1
tctcacaaaaacctcatcaatcacaaccatgggttcaacaggtgagactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1155 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1156 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1157 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1158 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagcagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1159 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccattcaattagcaagtgctccagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1160 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgcttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1161 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1162 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1163 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1164 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaactcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1165 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaactcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1166 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctgttgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1167 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1168 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1169 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 1170 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1171 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1172 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 1173 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgtccagttcgtactcaacaagatggaaagattcagagactttatggtttggctactgttgctaa

SEQ ID NO: 1174 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1175 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1176 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1177 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1178 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacatgttcagttcgtactcaacaagatggaaaggttcagagactttatggtttggcgactgttgctaa

SEQ ID NO: 1179 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1180 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1181 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1182 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1183 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttctttccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1184 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctcaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1185 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1186 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1187 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1188 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1189 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatactcacttgttcagttcgtactcaacaagatggaaagattcagagactttatggtttggctactgttgctaa

SEQ ID NO: 1190 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgattgttgcgtctcttggcttgttacaatatcctcacttgttcagttcgtactcaacaagatggaaaggttcagagactttatggtttggctactgttgctaa

SEQ ID NO: 1191 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1192 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1193 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1194 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1195 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagctcgtactcaacaagatggaaaggttcagagactttatggtttggctactgttgctaa

SEQ ID NO: 1196 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcccagactttatggtttggctactgttgctaa

SEQ ID NO: 1197 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttgaaatcagctcctgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1198 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1199 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1200 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 1201 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1202 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1203 - DNA, 349 bp, Artificial
  MsCOMT deletion introduced by TALEN pair MsCOMT_T01.1
tctcacaaaaacctcatcaatcacaaccatgggttcaacaggtgacccacatatcagatgaagaagcaaacctcttcgccatgcaacaagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacatgttcagttcgtactcaacaaggtggaatgactcagagactttatggtttggctactgttgctaa

SEQ ID NO: 1204 - DNA, 362 bp, Artificial
  MsCOMT deletion introduced by TALEN pair MsCOMT_T01.1
tctcacaaaaacctcatcaatcacaaccatgggttcaacaggtgacactcaaattaacccacatatcagatgaagaagcaaacctcttcgccatgcaactagcaagtgcttcagttcttcccatgattttgaaatcagctcttgaacttgatctcttagaactcattgctaaagctggacctggtgctcaattttcacctattgaaattgcttctcagctaccaacaactaaccctgatgcaccagttatgttggaccgaatgttgcgtctcttggcttgttacaatatcctcacgtgttcagttcttactcaacaagatggaaaagttcggagtctttatggtttggctactgtgtgctaa

SEQ ID NO: 1205 - DNA, 358 bp, Artificial
  MsCOMT deletion introduced by TALEN pair MsCOMT_T01.1
tctcacaaaaacctcatcaatcacaaccatgggttcaacaggtgacactcaaaccccacatatcagatgaagaagcaaacctcttcgccatgcaattagcaagtgcttcagttcttcccatgattttgccctcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1206 - DNA, 360 bp, Artificial
  MsCOMT deletion introduced by TALEN pair MsCOMT_T01.1
tctcacaaaaacctcatcaatcacaaccatgggttcaacaggtgaatctcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1207 - DNA, 360 bp, Artificial
  MsCOMT deletion introduced by TALEN pair MsCOMT_T01.1
tctcacaaaaacctcatcaatcacaaccatgggttcaacaggtgaatctcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1208 - DNA, 364 bp, Artificial
  MsCOMT deletion introduced by TALEN pair MsCOMT_T01.1
tctcacaaaaacctcatcaatcacaaccatgggttcaacaggtgaatctcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1209 - DNA, 357 bp, Artificial
  MsCOMT deletion introduced by TALEN pair MsCOMT_T01.1
tctcacaaaaacctcatcaatcacaaccatgggttcaacaggtgaatctcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1210 - DNA, 358 bp, Artificial
  MsCOMT deletion introduced by TALEN pair MsCOMT_T01.1
tctcacaaaaacctcatcaatcacaaccatgggttcaacaggtgaatctcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1211 - DNA, 333 bp, Artificial
  MsCOMT deletion introduced by TALEN pair MsCOMT_T01.1
tctcacaaaaacctcatcaatcacaaccatgggttcaacaggtgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1212 - DNA, 333 bp, Artificial
  MsCOMT deletion introduced by TALEN pair MsCOMT_T01.1
tctcacaaaaacctcatcaatcacaaccatgggttcaacaggtgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1213 - DNA, 333 bp, Artificial
  MsCOMT deletion introduced by TALEN pair MsCOMT_T01.1
tctcacaaaaacctcatcaatcacaaccatgggttcaacaggtgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1214 - DNA, 333 bp, Artificial
  MsCOMT deletion introduced by TALEN pair MsCOMT_T01.1
tctcacaaaaacctcatcaatcacaaccatgggttcaacaggtgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1215 - DNA, 333 bp, Artificial
  MsCOMT deletion introduced by TALEN pair MsCOMT_T01.1
tctcacaaaaacctcatcaatcacaaccatgggttcaacaggtgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 1216 - DNA, 333 bp, Artificial
  MsCOMT deletion introduced by TALEN pair MsCOMT_T01.1
tctcacaaaaacctcatcaatcacaaccatgggttcaacaggtgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1217 - DNA, 333 bp, Artificial
  MsCOMT deletion introduced by TALEN pair MsCOMT_T01.1
tctcacaaaaacctcatcaatcacaaccatgggttcaacaggtgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1218 - DNA, 333 bp, Artificial
  MsCOMT deletion introduced by TALEN pair MsCOMT_T01.1
tctcacaaaaacctcatcaatcacaaccatgggttcaacaggtgaagaagcaaccctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1219 - DNA, 333 bp, Artificial
  MsCOMT deletion introduced by TALEN pair MsCOMT_T01.1
tctcacaaaaacctcatcaatcacaaccatgggttcaacaggtgaagaagcaaccctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1220 - DNA, 333 bp, Artificial
  MsCOMT deletion introduced by TALEN pair MsCOMT_T01.1
tctcacaaaaacctcatcaatcacaaccatgggttcaacaggtgaagaagcaaccctcttcgcaatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1221 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgctatgcaactagcaagtgcttcagttcttcccatgattttgaaatcagctcttgaacttgatctcttagaaatcattgctaaagctggacctggtgctcaaatttcacctattgaaattgctcctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1222 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcgattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1223 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1224 - DNA, 334 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaac

SEQ ID NO: 1225 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1226 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1227 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 1228 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1229 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcatcagtcatgttggaccgaatgttgcgtctcttggcttgttacaatatcctcacttgttctgttcgtactcaacaagatggaaaggttcagagactttatggtttggctactgttgctaa

SEQ ID NO: 1230 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1231 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1232 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgttctcaacaagatggaaagattcagagactttatggtttggctactgttgctaa

SEQ ID NO: 1233 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1234 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 1235 - DNA, 332 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 1236 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaagattcagagactttatggtttggctactgttgctaa

SEQ ID NO: 1237 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1238 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1239 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1240 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1241 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatccgcacttgttcagttcgtacgcaacaagatggaaaggttcagaggctttatggtttggctactgttgctaa

SEQ ID NO: 1242 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1243 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1244 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttgcaatatcctcacttgttctgttcgtactcaacaagatggaaaggttcagagactttatggtttggctactgttgctaa

SEQ ID NO: 1245 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1246 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1247 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1248 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1249 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1250 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaagattcagagactctatggtttggctactgttgctaa

SEQ ID NO: 1251 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttattcagttcgtactcaacaagatggaaaggttcagagactttatggtttggctactgttgctaa

SEQ ID NO: 1252 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgcatgttgcgtctcttggcttgttacaatatcctcacttgttcagttcgtactcaacaagatggaaagattcagagactttatggtttggctactgttgctaa

SEQ ID NO: 1253 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttgcaatatcctcacttgttcaggtcgtactaaacaagatagaaagattcagagactgtagggtttggcaactagtgctaa

SEQ ID NO: 1254 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1255 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1256 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1257 - DNA, 332 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 1258 - DNA, 332 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 1259 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactctttcagttcgtactcaacaagatggaaaggttcagagactttatggtttggctactgttgctaa

SEQ ID NO: 1260 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1261 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacgatatcctcacttgttcagttcgtactcaacaagatggaaaggttcagagactttatggtttggctactgttgctaa

SEQ ID NO: 1262 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 1263 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1264 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 1265 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1266 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1267 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaagattcagagactttatggtttggctactgttgctaa

SEQ ID NO: 1268 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1269 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1270 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1271 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1272 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1273 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1274 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagtgcttcagttcttcccatgattttaaaatcagcccttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1275 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1276 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1277 - DNA, 333 bp, Artificial
  MsCOMT deletion introduced by TALEN pair MsCOMT_T01.1
tctcacaaaaacctcatcaatcacaaccatgggttcaacaggtgaagaagcaaacctcttcgccatccaactagcaagtgcttcagttcttcccatgattttgaaatcagctcttgaacttgatctcttagaaatcattgctaaagctggacctggtgctcaaatttcacctattgaaattgcttctcagctaccaacaactagccctgatgcaccagttatgttggaccgaatgttccgtctcttggcttgttacaatttcctcgcttgttcagttcgtactcagcaagatggaaagattcagagtctgtatggtttggctactgttgctaa

SEQ ID NO: 1278 - DNA, 350 bp, Artificial
  MsCOMT deletion introduced by TALEN pair MsCOMT_T01.1
tctcacaaaaacctcatcaatcacaaccatgggttcaacaggtgaacccccatctcagatgaagaagcaaacctcttcgctatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1279 - DNA, 350 bp, Artificial
  MsCOMT deletion introduced by TALEN pair MsCOMT_T01.1
tctcacaaaaacctcatcaatcacaaccatgggttcaacaggtgaacccacatctcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1280 - DNA, 350 bp, Artificial
  MsCOMT deletion introduced by TALEN pair MsCOMT_T01.1
tctcacaaaaacctcatcaatcacaaccatgggttcaacaggtgaacccacatctcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1281 - DNA, 350 bp, Artificial
  MsCOMT deletion introduced by TALEN pair MsCOMT_T01.1
tctcacaaaaacctcatcaatcacaaccatgggttcaacaggtgaacccacatctcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1282 - DNA, 350 bp, Artificial
  MsCOMT deletion introduced by TALEN pair MsCOMT_T01.1
tctcacaaaaacctcatcaatcacaaccatgggttcaacaggtgaacccacatctcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1283 - DNA, 350 bp, Artificial
  MsCOMT deletion introduced by TALEN pair MsCOMT_T01.1
tctcacaaaaacctcatcaatcacaaccatgggttcaacaggtgaacccacatctcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1284 - DNA, 350 bp, Artificial
  MsCOMT deletion introduced by TALEN pair MsCOMT_T01.1
tctcacaaaaacctcatcaatcacaaccatgggttcaacaggtgaacccacatctcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1285 - DNA, 348 bp, Artificial
  MsCOMT deletion introduced by TALEN pair MsCOMT_T01.1
tctcacaaaaacctcatcaatcacaaccatgggttcaacaggtgaacccacatctcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgcta

SEQ ID NO: 1286 - DNA, 350 bp, Artificial
  MsCOMT deletion introduced by TALEN pair MsCOMT_T01.1
tctcacaaaaacctcatcaatcacaaccatgggttcaacaggtgaacccacatctcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1287 - DNA, 350 bp, Artificial
  MsCOMT deletion introduced by TALEN pair MsCOMT_T01.1
tctcacaaaaacctcatcaatcacaaccatgggttcaacaggtgaacccacatctcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1288 - DNA, 350 bp, Artificial
  MsCOMT deletion introduced by TALEN pair MsCOMT_T01.1
tctcacaaaaacctcatcaatcacaaccatgggttcaacaggtgaacccacatctcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1289 - DNA, 350 bp, Artificial
  MsCOMT deletion introduced by TALEN pair MsCOMT_T01.1
tctcacaaaaacctcatcaatcacaaccatgggttcaacaggtgaacccacatctaagatgaagaagcaaacctcttcgccatgcaattagcaagtgcttcagttcttcccattattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1290 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 1291 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1292 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1293 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaataagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1294 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1295 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1296 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1297 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1298 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1299 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1300 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 1301 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1302 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1303 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1304 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1305 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1306 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgatacaatatcctcacttggtcatttcgtactcaacaagatggaaaggttcagagactttatggtttggctactggtgctaa

SEQ ID NO: 1307 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 1308 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1309 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1310 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1311 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1312 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1313 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 1314 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaattagcaagagcttcagttcttcccattattttaaaatcagctctttaacttgatctcttagaaatcattgctaaagctggacctggtgctcaaatttaacctgtgcaaaatgcttctcagcttccaacaactaaccctgatgcaccagtcatgttggaccgaatgttgcgtctcttggcttgttacaatatcctcacttgttctgttcctactcaacaagatggaaaggttcagagactttatggtttggctactgttgctaa

SEQ ID NO: 1315 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgacatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1316 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1317 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1318 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1319 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1320 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 1321 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1322 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 1323 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1324 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatccgcacttgttcagttcgtactcaacaagatggaaagattcagagactttatggtttggctactgtggctaa

SEQ ID NO: 1325 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 1326 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1327 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1328 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1329 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 1330 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1331 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaatcactgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1332 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttgaaatcagctcttgaacttgatctcttagaaagtattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1333 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1334 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1335 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1336 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgataa

SEQ ID NO: 1337 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1338 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 1339 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1340 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 1341 - DNA, 349 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcagttcttcccatgatttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1342 - DNA, 350 bp, Artificial
  MsCOMT deletion introduced by TALEN pair MsCOMT_T01.1
tctcacaaaaacctcatcaatcacaaccatgggttcaacaggtgaacccacatatcagatgaagaagcaaacctcttcgccatgcaactagcaagtgcttcaattcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1343 - DNA, 360 bp, Artificial
  MsCOMT deletion introduced by TALEN pair MsCOMT_T01.1
tctcacaaaaacctcatcaatcacaaccatgggttcaacaggtgaaattcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1344 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1345 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1346 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1347 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1348 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1349 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1350 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1351 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1352 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1353 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 1354 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 1355 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1356 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1357 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1358 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1359 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1360 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1361 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1362 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttagggtttggctactgttgctaa

SEQ ID NO: 1363 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1364 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1365 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1366 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1367 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1368 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1369 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1370 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1371 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatattgcgtctcttggcttgttacaatatcctcacttgttcagttcgtactcaacaagatggaaagattcagagactttatggtttggctactgttgctaa

SEQ ID NO: 1372 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1373 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1374 - DNA, 356 bp, Artificial
  MsCOMT deletion introduced by TALEN pair MsCOMT_T01.1
tctcacaaaaacctcatcaatcacaaccatgggttcaacaggtgaaatccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1375 - DNA, 354 bp, Artificial
  MsCOMT deletion introduced by TALEN pair MsCOMT_T01.1
tctcacaaaaacctcatcaatcacaaccatgggttcaacaggtgaaataacccccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1376 - DNA, 354 bp, Artificial
  MsCOMT deletion introduced by TALEN pair MsCOMT_T01.1
tctcacaaaaacctcatcaatcacaaccatgggttcaacaggtgaaataacccccatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1377 - DNA, 354 bp, Artificial
  MsCOMT deletion introduced by TALEN pair MsCOMT_T01.1
tctcacaaaaacctcatcaatcacaaccatgggttcaacaggtgaaataacccccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1378 - DNA, 354 bp, Artificial
  MsCOMT deletion introduced by TALEN pair MsCOMT_T01.1
tctcacaaaaacctcatcaatcacaaccatgggttcaacaggtgaaataacccccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1379 - DNA, 354 bp, Artificial
  MsCOMT deletion introduced by TALEN pair MsCOMT_T01.1
tctcacaaaaacctcatcaatcacaaccatgggttcaacaggtgaaataacccccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1380 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaataatcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1381 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1382 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1383 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaatcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1384 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1385 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1386 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1387 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1388 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1389 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1390 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1391 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1392 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1393 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1394 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 1395 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1396 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1397 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1398 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1399 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagtttgtactcaacaagatggaaaggttcagagactttatggtttggctactgttgctaa

SEQ ID NO: 1400 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1401 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1402 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1403 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1404 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaacttccaacaactaaccctgatgcatcagttatgttggaccgaatgttgcgtctcttggcttgttacaatatcctcacttgttcagttcgtactcaacaagatggaaagattcagagactttatggtttggctactgttgctaa

SEQ ID NO: 1405 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1406 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1407 - DNA, 354 bp, Artificial
  MsCOMT deletion introduced by TALEN pair MsCOMT_T01.1
tctcacaaaaacctcatcaatcacaaccatgggttcaacaggtgaaataacccacatatcagatgaagaagcaaacctcttcgccatgcaactagcaaatgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1408 - DNA, 361 bp, Artificial
  MsCOMT deletion introduced by TALEN pair MsCOMT_T01.1
tctcacaaaaacctcatcaatcacaaccatgggttcaacaggtgaaacttaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggttcggctactgttgctaa

SEQ ID NO: 1409 - DNA, 355 bp, Artificial
  MsCOMT deletion introduced by TALEN pair MsCOMT_T01.1
tctcacaaaaacctcatcaatcacaaccatgggttcaacaggtgaaacttaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1410 - DNA, 346 bp, Artificial
  MsCOMT deletion introduced by TALEN pair MsCOMT_T01.1
tctcacaaaaacctcatcaatcacaaccatgggttcaacaggtgaaactctcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1411 - DNA, 360 bp, Artificial
  MsCOMT deletion introduced by TALEN pair MsCOMT_T01.1
tctcacaaaaacctcatcaatcacaaccatgggttcaacaggtgaaactctaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 1412 - DNA, 355 bp, Artificial
  MsCOMT deletion introduced by TALEN pair MsCOMT_T01.1
tctcacaaaaacctcatcaatcacaaccatgggttcaacaggtgaaactcgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctaaccctgatgcaccagttatgttggaccaaagtttccgtcccttgccttttaccattatctccattgttccattccgacccaacaagatggaaagattcagagactttatggtttggctactgttgctaa

SEQ ID NO: 1413 - DNA, 359 bp, Artificial
  MsCOMT deletion introduced by TALEN pair MsCOMT_T01.1
tctcacaaaaacctcatcaatcacaaccatgggttcaacaggtgaaactcgaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1414 - DNA, 363 bp, Artificial
  MsCOMT deletion introduced by TALEN pair MsCOMT_T01.1
tctcacaaaaacctcatcaatcacaaccatgggttcaacaggtgaaactcgaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1415 - DNA, 363 bp, Artificial
  MsCOMT deletion introduced by TALEN pair MsCOMT_T01.1
tctcacaaaaacctcatcaatcacaaccatgggttcaacaggtgaaactcgaataccaacccacatatcagatgaagaagcaaacgtcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatattctaccgaattttgcctctcttgtcttattacaatatcctcacttcttcatttcctactcaacaatatataaatgttcaaagactttatggtttagctactattgctaa

SEQ ID NO: 1416 - DNA, 360 bp, Artificial
  MsCOMT deletion introduced by TALEN pair MsCOMT_T01.1
tctcacaaaaacctcatcaatcacaaccatgggttcaacaggtgaaactcgaataacccacatatcagatgaagaagcaaacctcttcgccatgcaattagcgagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1417 - DNA, 359 bp, Artificial
  MsCOMT deletion introduced by TALEN pair MsCOMT_T01.1
tctcacaaaaacctcatcaatcacaaccatgggttcaacaggtgaaactcgaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1418 - DNA, 364 bp, Artificial
  MsCOMT deletion introduced by TALEN pair MsCOMT_T01.1
tctcacaaaaacctcatcaatcacaaccatgggttcaacaggtgaaactcgaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1419 - DNA, 352 bp, Artificial
  MsCOMT deletion introduced by TALEN pair MsCOMT_T01.1
tctcacaaaaacctcatcaatcacaaccatgggttcaacaggtgaaactccacctatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1420 - DNA, 352 bp, Artificial
  MsCOMT deletion introduced by TALEN pair MsCOMT_T01.1
tctcacaaaaacctcatcaatcacaaccatgggttcaacaggtgaaactccacctatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1421 - DNA, 352 bp, Artificial
  MsCOMT deletion introduced by TALEN pair MsCOMT_T01.1
tctcacaaaaacctcatcaatcacaaccatgggttcaacaggtgaaactccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1422 - DNA, 352 bp, Artificial
  MsCOMT deletion introduced by TALEN pair MsCOMT_T01.1
tctcacaaaaacctcatcaatcacaaccatgggttcaacaggtgaaactccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacattatcctcacttgttcagttcgtactcaacaagatggaaaggttcagagactttatggtttggctactgttgctaa

SEQ ID NO: 1423 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1424 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1425 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcacttagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1426 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1427 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1428 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1429 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1430 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1431 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1432 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttctgttcgtactcaacaagatggaaaggttcagagactttatggtttggctactgttgctaa

SEQ ID NO: 1433 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1434 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1435 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1436 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1437 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1438 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1439 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggtccgaatgttgcgtctcttggcttgttacaatatcctcgcttgttcagttcgtactcaacaagatggaaagattcagagactttatggtttggctactgttgctaa

SEQ ID NO: 1440 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1441 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1442 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 1443 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1444 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1445 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1446 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcatcacttgttcagttcgtactcaacaagatggaaagattcagagactttatggtttggctactgttgctaa

SEQ ID NO: 1447 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttgtggtttggctactgttgctaa

SEQ ID NO: 1448 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1449 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctggttgcaatatcctcacttgttcagttcgtactcaacaagatggaaaggttcagagactttatggtttggctactgttgctaa

SEQ ID NO: 1450 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1451 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccatgattttaaaataagctcttgaacttgatctcttagaaatcattgctaaagctggacctggtgctcaaatttcacctattgaaattgcttctcagctcccaacaactaaccctgatgcgccagttatgttggaccgaatgttgcgtctcttggcttgttacaatatcctcccttgttcagttcgtactcaacaagacggaaaagttcagagactttatggtttggctactgttgctaa

SEQ ID NO: 1452 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtgcttcagttcttcccacgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1453 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagcaagtacttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1454 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaattagaaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 1455 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 1456 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1457 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1458 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1459 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctgctgttgctaa

SEQ ID NO: 1460 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1461 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1462 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1463 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1464 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1465 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1466 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctcttcgcaatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1467 - DNA, 352 bp, Artificial
  MsCOMT deletion introduced by TALEN pair MsCOMT_T01.1
tctcacaaaaacctcatcaatcacaaccatgggttcaacaggtgaaactccacatatcagatgaagaagcaaacctctacgacatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1468 - DNA, 360 bp, Artificial
  MsCOMT deletion introduced by TALEN pair MsCOMT_T01.1
tctcacaaaaacctcatcaatcacaaccatgggttcaacaggtgaaactccaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1469 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttggccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1470 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1471 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1472 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1473 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1474 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagatatgttggaccgaatgttgcgtctcttggcttgttacaatatcctcacttgttcagttcgtactcaacaagatggaaaggttcagagactttatggtttggctactgttgctaa

SEQ ID NO: 1475 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1476 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1477 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1478 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgatattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1479 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1480 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1481 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1482 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1483 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1484 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgggttgatacaatatccgcacttgttcagttcgtcctcaacaagatggaaaggttctgagactatatggtttggctactgttgctaa

SEQ ID NO: 1485 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 1486 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1487 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1488 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacttaacaagatggaaagattcagagactttatggtttggctactgttgctaa

SEQ ID NO: 1489 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1490 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 1491 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagtgcctcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1492 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1493 - DNA, 355 bp, Artificial
  MsCOMT deletion introduced by TALEN pair MsCOMT_T01.1
tctcacaaaaacctcatcaatcacaaccatgggttcaacaggtgaaactccaacccatatcagatgaagaagcaaacctcttcgccatgcaactaccaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1494 - DNA, 357 bp, Artificial
  MsCOMT deletion introduced by TALEN pair MsCOMT_T01.1
tctcacaaaaacctcatcaatcacaaccatgggttcaacaggtgaaactccaacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1495 - DNA, 357 bp, Artificial
  MsCOMT deletion introduced by TALEN pair MsCOMT_T01.1
tctcacaaaaacctcatcaatcacaaccatgggttcaacaggtgaaactccaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1496 - DNA, 356 bp, Artificial
  MsCOMT deletion introduced by TALEN pair MsCOMT_T01.1
tctcacaaaaacctcatcaatcacaaccatgggttcaacaggtgaaactccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagctggaaaggttcagagactttatggtttggctactgtgctaa

SEQ ID NO: 1497 - DNA, 357 bp, Artificial
  MsCOMT deletion introduced by TALEN pair MsCOMT_T01.1
tctcacaaaaacctcatcaatcacaaccatgggttcaacaggtgaaactccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1498 - DNA, 357 bp, Artificial
  MsCOMT deletion introduced by TALEN pair MsCOMT_T01.1
tctcacaaaaacctcatcaatcacaaccatgggttcaacaggtgaaactccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1499 - DNA, 357 bp, Artificial
  MsCOMT deletion introduced by TALEN pair MsCOMT_T01.1
tctcacaaaaacctcatcaatcacaaccatgggttcaacaggtgaaactccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaggatggaaaggttcagagactttatggtttggctactgttgctaa

SEQ ID NO: 1500 - DNA, 357 bp, Artificial
  MsCOMT deletion introduced by TALEN pair MsCOMT_T01.1
tctcacaaaaacctcatcaatcacaaccatgggttcaacaggtgaaactccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatccgcacatgttcagttcgtactcaacaagatggaaaggttcagagactttatggtttggctactgttgctaa

SEQ ID NO: 1501 - DNA, 357 bp, Artificial
  MsCOMT deletion introduced by TALEN pair MsCOMT_T01.1
tctcacaaaaacctcatcaatcacaaccatgggttcaacaggtgaaactccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1502 - DNA, 357 bp, Artificial
  MsCOMT deletion introduced by TALEN pair MsCOMT_T01.1
tctcacaaaaacctcatcaatcacaaccatgggttcaacaggtgaaactccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1503 - DNA, 357 bp, Artificial
  MsCOMT deletion introduced by TALEN pair MsCOMT_T01.1
tctcacaaaaacctcatcaatcacaaccatgggttcaacaggtgaaactccaacccacatatcagatgaagaagcaaacctcttcgccatgcaattagcaagtgcttcagttcttcccatgatttcaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1504 - DNA, 357 bp, Artificial
  MsCOMT deletion introduced by TALEN pair MsCOMT_T01.1
tctcacaaaaacctcatcaatcacaaccatgggttcaacaggtgaaactccaacccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1505 - DNA, 359 bp, Artificial
  MsCOMT deletion introduced by TALEN pair MsCOMT_T01.1
tctcacaaaaacctcatcaatcacaaccatgggttcaacaggtgaaactcatccacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1506 - DNA, 359 bp, Artificial
  MsCOMT deletion introduced by TALEN pair MsCOMT_T01.1
tctcacaaaaacctcatcaatcacaaccatgggttcaacaggtgaaactcatccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 1507 - DNA, 359 bp, Artificial
  MsCOMT deletion introduced by TALEN pair MsCOMT_T01.1
tctcacaaaaacctcatcaatcacaaccatgggttcaacaggtgaaactcatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1508 - DNA, 359 bp, Artificial
  MsCOMT deletion introduced by TALEN pair MsCOMT_T01.1
tctcacaaaaacctcatcaatcacaaccatgggttcaacaggtgaaactcatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1509 - DNA, 359 bp, Artificial
  MsCOMT deletion introduced by TALEN pair MsCOMT_T01.1
tctcacaaaaacctcatcaatcacaaccatgggttcaacaggtgaaactcatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1510 - DNA, 349 bp, Artificial
  MsCOMT deletion introduced by TALEN pair MsCOMT_T01.1
tctcacaaaaacctcatcaatcacaaccatgggttcaacaggtgaaactcatatcagatggagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1511 - DNA, 348 bp, Artificial
  MsCOMT deletion introduced by TALEN pair MsCOMT_T01.1
tctcacaaaaacctcatcaatcacaaccatgggttcaacaggtgaaactcatatcagatggagaagcaaacctcttcgccatgcaactagcaagtgcttcagttattcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactaaacaagatggaaaggttcagagactttatggtttggctactgttgcta

SEQ ID NO: 1512 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1513 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaataagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1514 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagtaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1515 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1516 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1517 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaattagcaagtgcttcagttcttcccatgattttgaaatcagctcttgaacctgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 1518 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1519 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1520 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1521 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1522 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1523 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1524 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactcgcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1525 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1526 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1527 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1528 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1529 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1530 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1531 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 1532 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1533 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1534 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1535 - DNA, 348 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctggttacaatatcctcacttgttcggttcgtactcaacaagatggaaaagttcagagacttatggtttggctactgttgctaa

SEQ ID NO: 1536 - DNA, 348 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgaccgaatgttgcgtctcttggcttgttacaatatcctcacttgttcagttcgtactcaacaagatggaaaggttcagagactttatggtttggctactgttgctaa

SEQ ID NO: 1537 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1538 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 1539 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1540 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1541 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 1542 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1543 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttaaaatcagctcttgaacttgatctcttagaaatcattgctaaagctggacctggagctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1544 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaagaagcaaacctcttcgccatgcaactagcaagtgcttcagttcttcccatgattttaaaatcagctcttgaacttgatctcttagaaatcattgctaaagcaggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1545 - DNA, 349 bp, Artificial
  MsCOMT deletion introduced by TALEN pair MsCOMT_T01.1
tctcacaaaaacctcatcaatcacaaccatgggttcaacaggtgaaactcatatcagatgaacaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttacggtttggctactgttgctaa

SEQ ID NO: 1546 - DNA, 363 bp, Artificial
  MsCOMT deletion introduced by TALEN pair MsCOMT_T01.1
tctcacaaaaacctcatcaatcacaaccatgggttcaacaggtgaaactcatataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1547 - DNA, 358 bp, Artificial
  MsCOMT deletion introduced by TALEN pair MsCOMT_T01.1
tctcacaaaaacctcatcaatcacaaccatgggttcaacaggtgaaactcataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1548 - DNA, 359 bp, Artificial
  MsCOMT deletion introduced by TALEN pair MsCOMT_T01.1
tctcacaaaaacctcatcaatcacaaccatgggttcaacaggtgaaactcagatacccacatatcagatgaagaagcaaacctcttcgccatgcaattagcaagtgcttcagttcttccaatgattttaaaatcagctcttgaacttgatctcttagaaatcattgctaaagctagacctggtgctcaaatttcacctattgaaattgcttctcagctcccaacaactaaccctgatgcaccagttatgttggaccgaatgttgcgtcacttggcttgttacaatatcctcacttgtgcagttcctactcaacaagatggaaaggttcagagactttatggtttggctactgttgctaa

SEQ ID NO: 1549 - DNA, 361 bp, Artificial
  MsCOMT deletion introduced by TALEN pair MsCOMT_T01.1
tctcacaaaaacctcatcaatcacaaccatgggttcaacaggtgaaactcagataaacccacatatcagatgaagaagcaaacctcttcgccatgcaactagcaagtgcttcagttcttcccatgattttgaaatcagctctcgaacttcatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1550 - DNA, 360 bp, Artificial
  MsCOMT deletion introduced by TALEN pair MsCOMT_T01.1
tctcacaaaaacctcatcaatcacaaccatgggttcaacaggtgaaactcagacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1551 - DNA, 358 bp, Artificial
  MsCOMT deletion introduced by TALEN pair MsCOMT_T01.1
tctcacaaaaacctcatcaatcacaaccatgggttcaacaggtgaaactcagaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1552 - DNA, 356 bp, Artificial
  MsCOMT deletion introduced by TALEN pair MsCOMT_T01.1
tctcacaaaaacctcatcaatcacaaccatgggttcaacaggtgaaactcaccccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 1553 - DNA, 359 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1554 - DNA, 359 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaattagcaagtgcttcagttcttcccatgattttaaaatcagctcttgaacttgatctcttagcaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1555 - DNA, 359 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1556 - DNA, 359 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1557 - DNA, 359 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1558 - DNA, 359 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1559 - DNA, 359 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1560 - DNA, 359 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1561 - DNA, 359 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1562 - DNA, 358 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaattagcaagtgcttcaggtcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactgttcagttcgtactcaacaagatggaaagattcagagactttatggtttggctactgttgctaa

SEQ ID NO: 1563 - DNA, 359 bp, Artificial
  MsCOMT deletion introduced by TALEN pair MsCOMT_T01.1
tctcacaaaaacctcatcaatcacaaccatgggttcaacaggtgaaactcacccacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1564 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1565 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1566 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1567 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1568 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaactttatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1569 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1570 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcgacaagatggaaaggttcagagactttatggtttggctactgttgctaa

SEQ ID NO: 1571 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1572 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1573 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1574 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1575 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1576 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1577 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1578 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcctgttacaatatcctcacttgttcagttcgtactcaacaagatggaaaggttcagagactttatggtttggctactgttgctaa

SEQ ID NO: 1579 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1580 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1581 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1582 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1583 - DNA, 355 bp, Artificial
  MsCOMT deletion introduced by TALEN pair MsCOMT_T01.1
tctcacaaaaacctcatcaatcacaaccatgggttcaacaggtgaaactcacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1584 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1585 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgacgaagcaaacctcttcgccgtgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1586 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgacgaagcaaacctcttcgccgtgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1587 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccgtgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1588 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccgtgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1589 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcatttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1590 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcccctattgaaattgcttctcagctcccaacaactaaccctgatgcaccagttatgttggaccgaatgttgcgtctcttggcttgttacaatttcctcacttgttcagttcttactcaacaagatggaaagattcagagactttattgtttggctactgttgctaa

SEQ ID NO: 1591 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1592 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1593 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgccaa

SEQ ID NO: 1594 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1595 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1596 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 1597 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaagatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1598 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1599 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1600 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1601 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 1602 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1603 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgtatgttgcgtctcttggcttgttacaatatcctcacttgttcagttcgtactcaacaagatggaaagattcagagactttatggtttggctactgttgctaa

SEQ ID NO: 1604 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 1605 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 1606 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1607 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1608 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1609 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaagttcagagactttatggtttggctactgttgctaa

SEQ ID NO: 1610 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 1611 - DNA, 358 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 1612 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttcttcccatgattttaaaatcagctcttgaacttgacctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1613 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaattagcaagtgcttcagttctccccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1614 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1615 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1616 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1617 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1618 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1619 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1620 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1621 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1622 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1623 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1624 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacccattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1625 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagatgaagaagcaaacctcatcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1626 - DNA, 359 bp, Artificial
  MsCOMT deletion introduced by TALEN pair MsCOMT_T01.1
tctcacaaaaacctcatcaatcacaaccatgggttcaacaggtgaaactcaccaacccacatatcagacgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1627 - DNA, 357 bp, Artificial
  MsCOMT deletion introduced by TALEN pair MsCOMT_T01.1
tctcacaaaaacctcatcaatcacaaccatgggttcaacaggtgaaactcacatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1628 - DNA, 351 bp, Artificial
  MsCOMT deletion introduced by TALEN pair MsCOMT_T01.1
tctcacaaaaacctcatcaatcacaaccatgggttcaacaggtgaaactcacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1629 - DNA, 351 bp, Artificial
  MsCOMT deletion introduced by TALEN pair MsCOMT_T01.1
tctcacaaaaacctcatcaatcacaaccatgggttcaacaggtgaaactcacatatcatatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1630 - DNA, 351 bp, Artificial
  MsCOMT deletion introduced by TALEN pair MsCOMT_T01.1
tctcacaaaaacctcatcaatcacaaccatgggttcaacaggtgaaactcacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1631 - DNA, 351 bp, Artificial
  MsCOMT deletion introduced by TALEN pair MsCOMT_T01.1
tctcacaaaaacctcatcaatcacaaccatgggttcaacaggtgaaactcacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 1632 - DNA, 351 bp, Artificial
  MsCOMT deletion introduced by TALEN pair MsCOMT_T01.1
tctcacaaaaacctcatcaatcacaaccatgggttcaacaggtgaaactcacatatcatataaagaagcaaaccttttcgccatgcaactagcaagtgtgtcagttcttcccatgattttgaaatcagctctttaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1633 - DNA, 350 bp, Artificial
  MsCOMT deletion introduced by TALEN pair MsCOMT_T01.1
tctcacaaaaacctcatcaatcacaaccatgggttcaacaggtgaaactcacatatcagatgaagaagcaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagatatgttggaccgaatgttgcgtctcttggcttgttacaatatcctcacttgttcagttcgtactcaacaagatggaaaggttcagagactttatggtttggctactgttgctaa

SEQ ID NO: 1634 - DNA, 350 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccctgcaactatcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactttgctaa

SEQ ID NO: 1635 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccctgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1636 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1637 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcacccgttatgttggaccgaatgttgcgtctcttggcttgttacaatatcctcacttgttcagttcgtactcaacaagatggaaaggttcagagactttatggtttggctactgttgctaa

SEQ ID NO: 1638 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1639 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1640 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1641 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1642 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1643 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1644 - DNA, 350 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 1645 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1646 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1647 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1648 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagttcttcggttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1649 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagttcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1650 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1651 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttctttccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1652 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttgaaatcagctcttgaacttgatctcttagaaatcattgctaaagctggacctggttctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1653 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1654 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgaccctgatgcaccagttatgttggaccgaatgttgcgtctcttggtttgttacaatatcctcacttgttctgttcgtactcaacaagatggaaaggttcagagactttatggtttggctactgttgctaa

SEQ ID NO: 1655 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1656 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttctgtgactttatggtttggctactgttgctaa

SEQ ID NO: 1657 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1658 - DNA, 350 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttctaa

SEQ ID NO: 1659 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1660 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1661 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1662 - DNA, 351 bp, Artificial
  MsCOMT deletion introduced by TALEN pair MsCOMT_T01.1
tctcacaaaaacctcatcaatcacaaccatgggttcaacaggtgaaactcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1663 - DNA, 351 bp, Artificial
  MsCOMT deletion introduced by TALEN pair MsCOMT_T01.1
tctcacaaaaacctcatcaatcacaaccatgggttcaacaggtgaaactcacataacacataaagaaacaaacctcgtcgccacgaaactatcaaccccttcagttcttcccattatttttaaatcagctctttaacttgatctcttagaaatcattgctatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1664 - DNA, 365 bp, Artificial
  MsCOMT deletion introduced by TALEN pair MsCOMT_T01.1
tctcacaaaaacctcatcaatcacaaccatgggttcaacaggtgaaactcaattacaccaaccccaatatcagatgaaggagcaaacctcttcgccattcaattagcaagttcttccgttcttcccatgattttaaaatcatctcttgaactttgtctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1665 - DNA, 350 bp, Artificial
  MsCOMT deletion introduced by TALEN pair MsCOMT_T01.1
tctcacaaaaacctcatcaatcacaaccatgggttcaacaggtgaaactcaatctcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1666 - DNA, 350 bp, Artificial
  MsCOMT deletion introduced by TALEN pair MsCOMT_T01.1
tctcacaaaaacctcatcaatcacaaccatgggttcaacaggtgaaactcaatctcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1667 - DNA, 350 bp, Artificial
  MsCOMT deletion introduced by TALEN pair MsCOMT_T01.1
tctcacaaaaacctcatcaatcacaaccatgggttcaacaggtgaaactcaatctcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1668 - DNA, 350 bp, Artificial
  MsCOMT deletion introduced by TALEN pair MsCOMT_T01.1
tctcacaaaaacctcatcaatcacaaccatgggttcaacaggtgaaactcaatctcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1669 - DNA, 350 bp, Artificial
  MsCOMT deletion introduced by TALEN pair MsCOMT_T01.1
tctcacaaaaacctcatcaatcacaaccatgggttcaacaggtgaaactcaatctcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 1670 - DNA, 350 bp, Artificial
  MsCOMT deletion introduced by TALEN pair MsCOMT_T01.1
tctcacaaaaacctcatcaatcacaaccatgggttcaacaggtgaaactcaatctcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1671 - DNA, 350 bp, Artificial
  MsCOMT deletion introduced by TALEN pair MsCOMT_T01.1
tctcacaaaaacctcatcaatcacaaccatgggttcaacaggtgaaactcaatctcagatgaagaagcaaacctcttcgccatgcaactagcaagtgcttcagttcttcccatgattttgacatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1672 - DNA, 350 bp, Artificial
  MsCOMT deletion introduced by TALEN pair MsCOMT_T01.1
tctcacaaaaacctcatcaatcacaaccatgggttcaacaggtgaaactcaatctcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1673 - DNA, 357 bp, Artificial
  MsCOMT deletion introduced by TALEN pair MsCOMT_T01.1
tctcacaaaaacctcatcaatcacaaccatgggttcaacaggtgaaactcaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1674 - DNA, 356 bp, Artificial
  MsCOMT deletion introduced by TALEN pair MsCOMT_T01.1
tctcacaaaaacctcatcaatcacaaccatgggttcaacaggtgaaactcaatccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1675 - DNA, 348 bp, Artificial
  MsCOMT deletion introduced by TALEN pair MsCOMT_T01.1
tctcacaaaaacctcatcaatcacaaccatgggttcaacaggtgaaactcaatcagattaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1676 - DNA, 348 bp, Artificial
  MsCOMT deletion introduced by TALEN pair MsCOMT_T01.1
tctcacaaaaacctcatcaatcacaaccatgggttcaacaggtgaaactcaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1677 - DNA, 348 bp, Artificial
  MsCOMT deletion introduced by TALEN pair MsCOMT_T01.1
tctcacaaaaacctcatcaatcacaaccatgggttcaacaggtgaaactcaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1678 - DNA, 348 bp, Artificial
  MsCOMT deletion introduced by TALEN pair MsCOMT_T01.1
tctcacaaaaacctcatcaatcacaaccatgggttcaacaggtgaaactcaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgctgcgtctcttggcttgttacaatatcctcacttgttcagttcgtactcaacaagatggaaaggttcagagactttatggtttggctactgttgctaa

SEQ ID NO: 1679 - DNA, 348 bp, Artificial
  MsCOMT deletion introduced by TALEN pair MsCOMT_T01.1
tctcacaaaaacctcatcaatcacaaccatgggttcaacaggtgaaactcaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1680 - DNA, 348 bp, Artificial
  MsCOMT deletion introduced by TALEN pair MsCOMT_T01.1
tctcacaaaaacctcatcaatcacaaccatgggttcaacaggtgaaactcaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1681 - DNA, 348 bp, Artificial
  MsCOMT deletion introduced by TALEN pair MsCOMT_T01.1
tctcacaaaaacctcatcaatcacaaccatgggttcaacaggtgaaactcaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatgggttggctactgttgctaa

SEQ ID NO: 1682 - DNA, 359 bp, Artificial
  MsCOMT deletion introduced by TALEN pair MsCOMT_T01.1
tctcacaaaaacctcatcaatcacaaccatgggttcaacaggtgaaactcaatcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1683 - DNA, 365 bp, Artificial
  MsCOMT deletion introduced by TALEN pair MsCOMT_T01.1
tctcacaaaaacctcatcaatcacaaccatgggttcaacaggtgaaactcaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1684 - DNA, 365 bp, Artificial
  MsCOMT deletion introduced by TALEN pair MsCOMT_T01.1
tctcacaaaaacctcatcaatcacaaccatgggttcaacaggtgaaactcaatcacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1685 - DNA, 350 bp, Artificial
  MsCOMT deletion introduced by TALEN pair MsCOMT_T01.1
tctcacaaaaacctcatcaatcacaaccatgggttcaacaggtgaaactcaatatccgctgacgcagcaaacctcttcgccatgcaattagcacgtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1686 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1687 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1688 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1689 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1690 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcgagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1691 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttgaaatcagctcttgaacttgatctcttagaaatcattgctaaagctggacctggtgctcaaatttcgcctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1692 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1693 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1694 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggctcagagactttatggtttggctactgttgctaa

SEQ ID NO: 1695 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1696 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 1697 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttgaaatcagctcttgaacttgaactcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1698 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttgaaatcagctcttgaacctgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1699 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggtcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1700 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1701 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1702 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1703 - DNA, 349 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 1704 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1705 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1706 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1707 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 1708 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1709 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1710 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaagattcagagactttatggtttggctactgttgctaa

SEQ ID NO: 1711 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1712 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 1713 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 1714 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1715 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 1716 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1717 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1718 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1719 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1720 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacccggtgctcaaatttcgcctattgaaattgcttctcagctcccagcaactaaccctttttcaccagttatgttggaccgaatgttgcgtctcttggcttgttacaatatcctcacttgttcagttcgtacgcaacaagatggaaagattcagagactttttggtgtggatactgttgctaa

SEQ ID NO: 1721 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1722 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaattagcaagtgcttcagttcttcccacgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1723 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1724 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1725 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1726 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1727 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 1728 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1729 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1730 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1731 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1732 - DNA, 350 bp, Artificial
  MsCOMT deletion introduced by TALEN pair MsCOMT_T01.1
tctcacaaaaacctcatcaatcacaaccatgggttcaacaggtgaaactcaatatcagatgaagaagcaaacctcttcgccatgcaaatagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1733 - DNA, 358 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 1734 - DNA, 358 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 1735 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 1736 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1737 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 1738 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcatcagttatgttggaccgaatgttgcgtctcttgacttgttacaatatcctcacttgttcagttcgtactcaacaagatggaaagattcagagactttatggtttggctactgttgctaa

SEQ ID NO: 1739 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1740 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1741 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1742 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaattagcaagtgcttcagttcttcccatgattttaaaatcagctcgtgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 1743 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcatttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1744 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttgaagtcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1745 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagacatcattgctaaagctggacctggtgctcaaatttcacctattgaaattgcttctcagctaccaacaactaaccctgatgcatcagttatgttggaccgaatgttgcgtctcttggcttgttacaatatcctcacttgttcagttcgtactcaacaagatggaaaggttcagagactttatggtttggctactgttgctaa

SEQ ID NO: 1746 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1747 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1748 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1749 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1750 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1751 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1752 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1753 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1754 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1755 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1756 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1757 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1758 - DNA, 359 bp, Artificial
  MsCOMT deletion introduced by TALEN pair MsCOMT_T01.1
tctcacaaaaacctcatcaatcacaaccatgggttcaacaggtgaaactcaataacccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1759 - DNA, 363 bp, Artificial
  MsCOMT deletion introduced by TALEN pair MsCOMT_T01.1
tctcacaaaaacctcatcaatcacaaccatgggttcaacaggtgaaactcaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1760 - DNA, 365 bp, Artificial
  MsCOMT deletion introduced by TALEN pair MsCOMT_T01.1
tctcacaaaaacctcatcaatcacaaccatgggttcaacaggtgaaactcaataacaccagcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1761 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaaggagcaaacctcttcgccattcaactagccaaggcctcagttcttcccatgattttgaaatcagctcttgaacttgatctcttagaaatcattgctaaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1762 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccattcaactagcaagtgcttcagttcttcccatgattttgaaatcagctcttgaacttgatctcttagaaatcattgccaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1763 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1764 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccatgcaattagcaagtgcttcagttcttcccatgattttaaaatcagctcttgaacttgatctcttagagatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1765 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1766 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1767 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1768 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccatgcaattagcaagtgcttcagttcttcccatgatttcaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1769 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1770 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1771 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1772 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1773 - DNA, 365 bp, Artificial
  MsCOMT deletion introduced by TALEN pair MsCOMT_T01.1
tctcacaaaaacctcatcaatcacaaccatgggttcaacaggtgaaactcaataacaccaacccaaatatccgatgaagaagcaaacctcttcgcccttccattagcaagtgcctcagttcttcccatgattttaaaatcagcccttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1774 - DNA, 362 bp, Artificial
  MsCOMT deletion introduced by TALEN pair MsCOMT_T01.1
tctcacaaaaacctcatcaatcacaaccatgggttcaacaggtgaaactcaataacaacccacatatcagatgaagaagcaaaccgcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgatgctaa

SEQ ID NO: 1775 - DNA, 359 bp, Artificial
  MsCOMT deletion introduced by TALEN pair MsCOMT_T01.1
tctcacaaaaacctcatcaatcacaaccatgggttcaacaggtgaaactcaataaaccacatatcagatgaagaagcaaaaatcttcgctatgcaactagcaagtgcttcagttcttcccatgattttgaaatcagctattgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1776 - DNA, 363 bp, Artificial
  MsCOMT deletion introduced by TALEN pair MsCOMT_T01.1
tctcacaaaaacctcatcaatcacaaccatgggttcaacaggtgaaactcaagtaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1777 - DNA, 361 bp, Artificial
  MsCOMT deletion introduced by TALEN pair MsCOMT_T01.1
tctcacaaaaacctcatcaatcacaaccatgggttcaacaggtgaaactcaagtaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1778 - DNA, 345 bp, Artificial
  MsCOMT deletion introduced by TALEN pair MsCOMT_T01.1
tctcacaaaaacctcatcaatcacaaccatgggttcaacaggtgaaactcaagctgaataagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1779 - DNA, 345 bp, Artificial
  MsCOMT deletion introduced by TALEN pair MsCOMT_T01.1
tctcacaaaaacctcatcaatcacaaccatgggttcaacaggtgaaactcaagctgaataagcaaacctcttcgccatgcaattagcacgtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1780 - DNA, 344 bp, Artificial
  MsCOMT deletion introduced by TALEN pair MsCOMT_T01.1
tctcacaaaaacctcatcaatcacaaccatgggttcaacaggtgaaactcaagctgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaaagttcagagactttatggtttggcactgttgctaa

SEQ ID NO: 1781 - DNA, 345 bp, Artificial
  MsCOMT deletion introduced by TALEN pair MsCOMT_T01.1
tctcacaaaaacctcatcaatcacaaccatgggttcaacaggtgaaactcaagctgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1782 - DNA, 345 bp, Artificial
  MsCOMT deletion introduced by TALEN pair MsCOMT_T01.1
tctcacaaaaacctcatcaatcacaaccatgggttcaacaggtgaaactcaagctgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1783 - DNA, 345 bp, Artificial
  MsCOMT deletion introduced by TALEN pair MsCOMT_T01.1
tctcacaaaaacctcatcaatcacaaccatgggttcaacaggtgaaactcaagctgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1784 - DNA, 345 bp, Artificial
  MsCOMT deletion introduced by TALEN pair MsCOMT_T01.1
tctcacaaaaacctcatcaatcacaaccatgggttcaacaggtgaaactcaagctgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1785 - DNA, 345 bp, Artificial
  MsCOMT deletion introduced by TALEN pair MsCOMT_T01.1
tctcacaaaaacctcatcaatcacaaccatgggttcaacaggtgaaactcaagctgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1786 - DNA, 345 bp, Artificial
  MsCOMT deletion introduced by TALEN pair MsCOMT_T01.1
tctcacaaaaacctcatcaatcacaaccatgggttcaacaggtgaaactcaagatgaataagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1787 - DNA, 345 bp, Artificial
  MsCOMT deletion introduced by TALEN pair MsCOMT_T01.1
tctcacaaaaacctcatcaatcacaaccatgggttcaacaggtgaaactcaagatgaataagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1788 - DNA, 345 bp, Artificial
  MsCOMT deletion introduced by TALEN pair MsCOMT_T01.1
tctcacaaaaacctcatcaatcacaaccatgggttcaacaggtgaaactcaagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1789 - DNA, 345 bp, Artificial
  MsCOMT deletion introduced by TALEN pair MsCOMT_T01.1
tctcacaaaaacctcatcaatcacaaccatgggttcaacaggtgaaactcaagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1790 - DNA, 345 bp, Artificial
  MsCOMT deletion introduced by TALEN pair MsCOMT_T01.1
tctcacaaaaacctcatcaatcacaaccatgggttcaacaggtgaaactcaagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1791 - DNA, 345 bp, Artificial
  MsCOMT deletion introduced by TALEN pair MsCOMT_T01.1
tctcacaaaaacctcatcaatcacaaccatgggttcaacaggtgaaactcaagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 1792 - DNA, 345 bp, Artificial
  MsCOMT deletion introduced by TALEN pair MsCOMT_T01.1
tctcacaaaaacctcatcaatcacaaccatgggttcaacaggtgaaactcaagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1793 - DNA, 345 bp, Artificial
  MsCOMT deletion introduced by TALEN pair MsCOMT_T01.1
tctcacaaaaacctcatcaatcacaaccatgggttcaacaggtgaaactcaagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1794 - DNA, 344 bp, Artificial
  MsCOMT deletion introduced by TALEN pair MsCOMT_T01.1
tctcacaaaaacctcatcaatcacaaccatgggttcaacaggtgaaactcaagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 1795 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcacgtgcttcatttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1796 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcacgtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1797 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcacgtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1798 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcacgtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1799 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcatttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1800 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcatttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1801 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcatttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1802 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1803 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 1804 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1805 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1806 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacagtatcctcacttgttcagttcgtactcaacaagatggaaaagttcagagactttatggtttggctactgttgctaa

SEQ ID NO: 1807 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1808 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1809 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1810 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 1811 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1812 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1813 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1814 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1815 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1816 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1817 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctctcaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1818 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttgtgttggaccgaatgttgcgtctcttggcttgttacaatatcctcacttgttcagttcgtactcaacaagatggaaagattcagagactttatggtttggctactgttgctaa

SEQ ID NO: 1819 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaagattcagagactttatggtttggctactgttgctaa

SEQ ID NO: 1820 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1821 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1822 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1823 - DNA, 340 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactgtatggtttggctagctaa

SEQ ID NO: 1824 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagaggctttatggtttggctactgttgctaa

SEQ ID NO: 1825 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttaaggtttggctactgttgctaa

SEQ ID NO: 1826 - DNA, 344 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgtaa

SEQ ID NO: 1827 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1828 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 1829 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1830 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1831 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1832 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1833 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactattgctaa

SEQ ID NO: 1834 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 1835 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaacttgatctcttagaaatcatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1836 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaattagcaagtgcttcagttcttcccatgattttaaaatcagctcttgaactagatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1837 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 1838 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1839 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1840 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1841 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1842 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1843 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1844 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1845 - DNA, 345 bp, Artificial
  MsCOMT deletion introduced by TALEN pair MsCOMT_T01.1
tctcacaaaaacctcatcaatcacaaccatgggttcaacaggtgaaactcaagatgaagaaacaaacctcttcgccatgcaatcagcaagcgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1846 - DNA, 345 bp, Artificial
  MsCOMT deletion introduced by TALEN pair MsCOMT_T01.1
tctcacaaaaacctcatcaatcacaaccatgggttcaacaggtgaaactcaagatgaacaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1847 - DNA, 356 bp, Artificial
  MsCOMT deletion introduced by TALEN pair MsCOMT_T01.1
tctcacaaaaacctcatcaatcacaaccatgggttcaacaggtgaaactcaactcacacatcacatgaagaagcaaaaatattcaacatgcaattagaaagagtttcagttcttcccatgattttaaaatcagctcttgaacttgatctcttagaaaccattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1848 - DNA, 361 bp, Artificial
  MsCOMT deletion introduced by TALEN pair MsCOMT_T01.1
tctcacaaaaacctcatcaatcacaaccatgggttcaacaggtgaaactcaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1849 - DNA, 361 bp, Artificial
  MsCOMT deletion introduced by TALEN pair MsCOMT_T01.1
tctcacaaaaacctcatcaatcacaaccatgggttcaacaggtgaaactcaactaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1850 - DNA, 352 bp, Artificial
  MsCOMT deletion introduced by TALEN pair MsCOMT_T01.1
tctcacaaaaacctcatcaatcacaaccatgggttcaacaggtgaaactcaacctatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1851 - DNA, 352 bp, Artificial
  MsCOMT deletion introduced by TALEN pair MsCOMT_T01.1
tctcacaaaaacctcatcaatcacaaccatgggttcaacaggtgaaactcaacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 1852 - DNA, 352 bp, Artificial
  MsCOMT deletion introduced by TALEN pair MsCOMT_T01.1
tctcacaaaaacctcatcaatcacaaccatgggttcaacaggtgaaactcaacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1853 - DNA, 352 bp, Artificial
  MsCOMT deletion introduced by TALEN pair MsCOMT_T01.1
tctcacaaaaacctcatcaatcacaaccatgggttcaacaggtgaaactcaacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1854 - DNA, 354 bp, Artificial
  MsCOMT deletion introduced by TALEN pair MsCOMT_T01.1
tctcacaaaaacctcatcaatcacaaccatgggttcaacaggtgaaactcaacccatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1855 - DNA, 354 bp, Artificial
  MsCOMT deletion introduced by TALEN pair MsCOMT_T01.1
tctcacaaaaacctcatcaatcacaaccatgggttcaacaggtgaaactcaacccatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1856 - DNA, 354 bp, Artificial
  MsCOMT deletion introduced by TALEN pair MsCOMT_T01.1
tctcacaaaaacctcatcaatcacaaccatgggttcaacaggtgaaactcaacccatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1857 - DNA, 354 bp, Artificial
  MsCOMT deletion introduced by TALEN pair MsCOMT_T01.1
tctcacaaaaacctcatcaatcacaaccatgggttcaacaggtgaaactcaacccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1858 - DNA, 354 bp, Artificial
  MsCOMT deletion introduced by TALEN pair MsCOMT_T01.1
tctcacaaaaacctcatcaatcacaaccatgggttcaacaggtgaaactcaacccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1859 - DNA, 354 bp, Artificial
  MsCOMT deletion introduced by TALEN pair MsCOMT_T01.1
tctcacaaaaacctcatcaatcacaaccatgggttcaacaggtgaaactcaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1860 - DNA, 354 bp, Artificial
  MsCOMT deletion introduced by TALEN pair MsCOMT_T01.1
tctcacaaaaacctcatcaatcacaaccatgggttcaacaggtgaaactcaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1861 - DNA, 354 bp, Artificial
  MsCOMT deletion introduced by TALEN pair MsCOMT_T01.1
tctcacaaaaacctcatcaatcacaaccatgggttcaacaggtgaaactcaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1862 - DNA, 354 bp, Artificial
  MsCOMT deletion introduced by TALEN pair MsCOMT_T01.1
tctcacaaaaacctcatcaatcacaaccatgggttcaacaggtgaaactcaacccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1863 - DNA, 356 bp, Artificial
  MsCOMT deletion introduced by TALEN pair MsCOMT_T01.1
tctcacaaaaacctcatcaatcacaaccatgggttcaacaggtgaaactcaacccacatgtcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacactatcctcacttgttcagttcgtactcaacaagatggaaaggttcagagactttatggtttggctactgttgctaa

SEQ ID NO: 1864 - DNA, 356 bp, Artificial
  MsCOMT deletion introduced by TALEN pair MsCOMT_T01.1
tctcacaaaaacctcatcaatcacaaccatgggttcaacaggtgaaactcaacccacatctcagatgaagaagcaaacctcttcgccatgcaattagcaagtgcttcagttcttcccatgattttgaaatcagctcttgaaattgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1865 - DNA, 356 bp, Artificial
  MsCOMT deletion introduced by TALEN pair MsCOMT_T01.1
tctcacaaaaacctcatcaatcacaaccatgggttcaacaggtgaaactcaacccacatctcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1866 - DNA, 356 bp, Artificial
  MsCOMT deletion introduced by TALEN pair MsCOMT_T01.1
tctcacaaaaacctcatcaatcacaaccatgggttcaacaggtgaaactcaacccacatattagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1867 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1868 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1869 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcctatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1870 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatccgctgaagaagcaaacctcttcgccatgcaattagaaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1871 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1872 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcatttcttcccatgattttaaaatcagctcttgagcttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1873 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 1874 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1875 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1876 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggtcctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1877 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1878 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1879 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1880 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1881 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 1882 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaagattcagagactttatggtttggctactgttgctaa

SEQ ID NO: 1883 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1884 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1885 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1886 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaattagcaagtgcttcagttcttcccatgattttaaaatcagctcttgaacttgatctcttagaaatcattgctaaagctggacctgatgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 1887 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 1888 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatccgcacttgtgctgttcgtactcaacaagatggaaaggttcagagactttatggtttggctactttgctaa

SEQ ID NO: 1889 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1890 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1891 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 1892 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1893 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 1894 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1895 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaagttcagagactttatggtttggctactgttgctaa

SEQ ID NO: 1896 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttagaccgaatgttgcgtctcttggcttgttacaatatcctcacttgttcagttcgtactcaacaagatggaaaggttcagagactttatggtttggctactgttgctaa

SEQ ID NO: 1897 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1898 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 1899 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1900 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1901 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcatatgaagaagcaaacctcttcgccatgcaactagcaagtgcttcagctcttcccatgattttgaaatcagctcttgaactcgatctcttagaaatcattgctaaagctggacctggtgctcaaatttcacctattgaaattgcttctcagctaccaacaactaaccctgatgcaccagttatgttggaccgaatgttgcgtctcttggcttgttacaatatccgcacttgttcagttcctactcaacaagatggaaaggttcagagactttatggtttggctactgttgctaa

SEQ ID NO: 1902 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagttgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggacctaatgttgcgtctcttggcttgttacaatatcctcacttgttcagttcgtactcaacaagatggaaagattcagagactttatggtttggctactgttgctaa

SEQ ID NO: 1903 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatggagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1904 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaataagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1905 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagacgcaaacctcttcgccatgcaattagcaagtgcttcagatcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1906 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagacgcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1907 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaagttcagagactttatggtttggctactgttgctaa

SEQ ID NO: 1908 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttctccatgcaactagcaagtgcttcagttcttcccatgattttgaaatcggctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1909 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1910 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgtcatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1911 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1912 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1913 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1914 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatggttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1915 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1916 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1917 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1918 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 1919 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1920 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1921 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1922 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 1923 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttaggctactgttgctaa

SEQ ID NO: 1924 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 1925 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1926 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1927 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1928 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1929 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1930 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1931 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1932 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 1933 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaacgaatgttgcgtctcttggcttgttacaatttcctcacttgttcagttcgttctcaacaagatggaaaagttcagagtctttatggtttggctactgttgctaa

SEQ ID NO: 1934 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagccaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1935 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttgaaatcagctcttgaacttgatctattagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagatactttatggtttggctactgttgctaa

SEQ ID NO: 1936 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagtaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1937 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1938 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1939 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1940 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaatctggacctggtgctcaaatttcacctattgaaattgcttctcagctcccaacaactaaccctgatgcaccagttatgttggaccgaatgttgcgtctcttggcttgttacaatatcctcccttgttcagttcgtactcaaccagatggaaaggttcagagcctttatggtttggctactgttgctaa

SEQ ID NO: 1941 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1942 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctgttgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1943 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaattttacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1944 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcatcagtcatgttggaccgaatgttgcgtctcttggcttgttacaatatcctcacttgttctgttcgtactcaacaagatggaaaggttcagagactttatggtttggctactgttgctaa

SEQ ID NO: 1945 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1946 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1947 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1948 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1949 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1950 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1951 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1952 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1953 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1954 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1955 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1956 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgacattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1957 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1958 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcttagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1959 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1960 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctccgctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1961 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1962 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 1963 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1964 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1965 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1966 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1967 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 1968 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactatatggtttggctactgttgctaa

SEQ ID NO: 1969 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactagttcagttcgtactcaacaagatggaaagattcagagactttatggtttggctactgttgctaa

SEQ ID NO: 1970 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 1971 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaagattcagagactttatggtttggctactgttgctaa

SEQ ID NO: 1972 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatggaaagattcagagactttatggtttggctactgttgctaa

SEQ ID NO: 1973 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 1974 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgatacaatatcctcacttgttcagttcgtacccaacaagatggaaagattcagagactttatggtttggctactgttgctaa

SEQ ID NO: 1975 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaaagttcagagactttatggtttggctactgttgctaa

SEQ ID NO: 1976 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 1977 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaagaagatggaaagattcagagactgtatggtttggctactggtgctaa

SEQ ID NO: 1978 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 1979 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttattcagttcgtactcaacaagatggaaagattcagagactttatggtttggctactgttgctaa

SEQ ID NO: 1980 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctaatgttgctaa

SEQ ID NO: 1981 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 1982 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttcggctactgttgctaa

SEQ ID NO: 1983 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgcta

SEQ ID NO: 1984 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgctggaccgaatgttgcgtctcttggcttgttacaatatcctcacttgttcagttcgtactcaacaagatggaaaagttcagagactttatggtttggctactgttgctaa

SEQ ID NO: 1985 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 1986 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggacctaatgttccgtctcatgaattgttacagtatcctcacttgttcagttcgtcctcaacaacatgcaaaggttcagaccctttatggtttggcaactgaagctaa

SEQ ID NO: 1987 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 1988 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 1989 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 1990 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1991 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 1992 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 1993 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgagtctcttggcttgttacaatatcctcacttgttcagttcgtactcaacaagatggaaaggttcagagactttatggtttggctactgttgctaa

SEQ ID NO: 1994 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaagttcagagactttatggtttggctactgttgctaa

SEQ ID NO: 1995 - DNA, 350 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactga

SEQ ID NO: 1996 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 1997 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 1998 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaattccacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 1999 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatctcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2000 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2001 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2002 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctagtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2003 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggaactggtgctcaaatttcaactgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2004 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggaactggtactcaaatttcacctattgaaattgcttctcagctcccaacaactaaccctgatgcaccagttatgttggaccgaattttgcgtctcttggcttgttacaatatcctcacttgttcagttcgtactcaacaagatggaaagattcagagactttatggtttggctactgttgctaa

SEQ ID NO: 2005 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttaaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2006 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttcccataattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2007 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagttcttccaattattttgaaatcagctcttgaacttgatctcttagaaatcattgctaaagctggacctggtgctcaaatttcacctattgaaattgcttctcagctaccaacaactaaccctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 2008 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgcttcagtccttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2009 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagtgctccagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2010 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2011 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaattagcaagagcttcagttcttcccatgattttacaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2012 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2013 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatctgctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2014 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgtacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 2015 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttggtctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2016 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2017 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2018 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaattttacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2019 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2020 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2021 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2022 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2023 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 2024 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2025 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccaatgttgcgtctcttggcttgttacaatatcctcacttgttctgttcgtactcaacaagatggaaaggttcagagactttatggtttggctactgttgctaa

SEQ ID NO: 2026 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacactatcctcacttgttcagttcgtactcaacaagatggaaagattcagagactttatggtttggctactgttgctaa

SEQ ID NO: 2027 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcaactaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2028 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2029 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2030 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctatgttgctaa

SEQ ID NO: 2031 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2032 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2033 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2034 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctctcaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2035 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2036 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2037 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2038 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2039 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2040 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2041 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 2042 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 2043 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttagctactgttgctaa

SEQ ID NO: 2044 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaagattcagagactttatggtttggctactgttgctaa

SEQ ID NO: 2045 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaggatggaaagattcagagactttatggtttggctactgttgctaa

SEQ ID NO: 2046 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 2047 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 2048 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 2049 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 2050 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 2051 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 2052 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgtttcgtctcttggcttgttacaatatcctcacttgttcagttcgtactcaacaagattgaaaggttcagagactttatggtttggctactgttgctaa

SEQ ID NO: 2053 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2054 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcactcgttctgttcgtactcaacaagatggaaagattcagagactttatggtttggctactgctgctaa

SEQ ID NO: 2055 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgaagcaccagtcatgttggaccgaatgttgcgtctcttggcttgttacaatatcctcacttgttctgttcgtactcaacaagatggaaaggttcagagactttatggtttggctactgttgctaa

SEQ ID NO: 2056 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatcaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2057 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2058 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 2059 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccatttatgttggaccgaatgttgcgtctcttggcttgttacaatatcctcacttgttcagttcgtactcaacaagatggaaagattcagagactttatggtttggctactgttgctaa

SEQ ID NO: 2060 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggacctaatgttgcgtctcttggcttgttacaatatcctcacttgttcagttcgtactcaacaagatggaaaagttcagagactttatggtttggctactgttgctaa

SEQ ID NO: 2061 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2062 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2063 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2064 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 2065 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 2066 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2067 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 2068 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtttcggctcctggcctgttacaatatcctcacttgttcagttcgtactcaacaagatggaaaggttcagagactttatggtttggctactgttgctaa

SEQ ID NO: 2069 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 2070 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 2071 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggtaaggttcagagactttatggtttggctactgttgctaa

SEQ ID NO: 2072 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatgggttggctactgttgctaa

SEQ ID NO: 2073 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaagttcagagactttatggtttggctactgttgctaa

SEQ ID NO: 2074 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 2075 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 2076 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctaacttgttcagttcgtactcaacaagatggaaaggttcagagactttatggtttggctactgttgctaa

SEQ ID NO: 2077 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 2078 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 2079 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaagttcagagactttatggtttggctactgttgctaa

SEQ ID NO: 2080 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 2081 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 2082 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcggactcaacaagatggaaaagttcagagactttatggtttggctactgttgctaa

SEQ ID NO: 2083 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 2084 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 2085 - DNA, 355 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 2086 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtgacaatatcctcacttgttcagttcgtactcaacaagatggaaaggttcagagactttatggtttggctactgttgctaa

SEQ ID NO: 2087 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcccttggcttgttacaatatcctcacttgttcagttcgtactcaacaagatggaaaggttcagagactttatggtttggctactgttgctaa

SEQ ID NO: 2088 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 2089 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaaggtggaaaggttcagagactttatggtttggctactgttgctaa

SEQ ID NO: 2090 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 2091 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2092 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2093 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2094 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcacctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2095 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2096 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatgtcacctattgaaattgcttctcagctaccagcaactaaccctgatgcaccagttctgttgggccgaatgttgcgtctcttggcttgttacaatatcctcgcttgttcagttcgtactcaacaagatggaaagattcagagactttatggtttggctactgttgctaa

SEQ ID NO: 2097 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcacccgttatgttggaccgaatgttgcgtctcttggcttgttacaatatcctcacttgttcagttcgtactcaacaagatggaaaggttcagagactttatggtttggctactgttgctaa

SEQ ID NO: 2098 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggcgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2099 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctgatgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2100 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgccaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2101 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2102 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2103 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2104 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2105 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2106 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2107 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2108 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2109 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2110 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2111 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2112 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2113 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2114 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2115 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactatccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2116 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2117 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2118 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2119 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2120 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacggttgctaa

SEQ ID NO: 2121 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgatggaccgaatgttgcgtctcttgacttgttacaatatcctcacttgttcagttcgtactcaacaagatggaaaggttcagagactttatggtttggctactgttgctaa

SEQ ID NO: 2122 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2123 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2124 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2125 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 2126 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2127 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacagtgtcctcacttgtttaattcgtactcaacaagatggaaaggttcagagactttatggtttggctactgtagctaa

SEQ ID NO: 2128 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2129 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 2130 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2131 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2132 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2133 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaacttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2134 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctctcagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2135 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctctcagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2136 - DNA, 354 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttcttcccatgatattgaaatcagctcttgaacttgatctcttagaaatcattgctaaagctggacctggtgctcaaatttcacctattgaaattgcttctcagctaccaacaactaaccctgatgcaccagttatgttggacagtatgttgcgtctctgggcttgttacaatatcctcttgttcagttcgtactcaacaagatggaaaagttcagagactttatggtttggctactgttgctaa

SEQ ID NO: 2137 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactagcaagtgcttcagttctacccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatttcctcacttgttcagttcgtactcaacaagatggaaagattcagagactttatggttgggctactgttgctaa

SEQ ID NO: 2138 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2139 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgccacgcaactagcaagtgcttcagttcttcccatgattttgaaagcagctcttgaacttgatctcttagaaatcattgctaaagctggacctggtgctcaaatttcacctattgaaattgcttctcagctaccaacaactaaccctgatgcaccagttatgttggaccggatgttgcgtctcttggcttgttacaatatcctcacttgttcagttcgtactcaacaagatggaaagattcagagactttatggtttggctactgttgctaa

SEQ ID NO: 2140 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcgcaatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2141 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcttcaccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2142 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaacctcgtcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgtttgaccgaatgttgcgtctcttggcttgttacaatatcctcacttgttcagttcgtactcaacaagatggaaaggttcagagactttattgtttggctactgttgctaa

SEQ ID NO: 2143 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagcaaaactcttcaacatgcaactagaaagagcttcaattcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2144 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcagatgaagaagaaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2145 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcacctcaagaaacatacctcttcgacatgcaattagaaacagcttcagttcttctcatgattttaaaatcatctcttaaacttgatctcttagaaatcattgctaaagctggacctagtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2146 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcacatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2147 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcacatgaaaaagcatacctcttcgccatgcaactagcaacaacttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2148 - DNA, 356 bp, Artificial
  MsCOMT deletion introduced by TALEN pair MsCOMT_T01.1
tctcacaaaaacctcatcaatcacaaccatgggttcaacaggtgaaactcaacccacatatcaaatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctta

SEQ ID NO: 2149 - DNA, 356 bp, Artificial
  MsCOMT deletion introduced by TALEN pair MsCOMT_T01.1
tctcacaaaaacctcatcaatcacaaccatgggttcaacaggtgaaactcaacccacataccagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2150 - DNA, 356 bp, Artificial
  MsCOMT deletion introduced by TALEN pair MsCOMT_T01.1
tctcacaaaaacctcatcaatcacaaccatgggttcaacaggtgaaactcaacccacataacagatcaagaaggaaaccgcttcgccattcaactagcaacaacttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2151 - DNA, 356 bp, Artificial
  MsCOMT deletion introduced by TALEN pair MsCOMT_T01.1
tctcacaaaaacctcatcaatcacaaccatgggttcaacaggtgaaactcaacccaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2152 - DNA, 359 bp, Artificial
  MsCOMT deletion introduced by TALEN pair MsCOMT_T01.1
tctcacaaaaacctcatcaatcacaaccatgggttcaacaggtgaaactcaaccacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2153 - DNA, 359 bp, Artificial
  MsCOMT deletion introduced by TALEN pair MsCOMT_T01.1
tctcacaaaaacctcatcaatcacaaccatgggttcaacaggtgaaactcaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2154 - DNA, 359 bp, Artificial
  MsCOMT deletion introduced by TALEN pair MsCOMT_T01.1
tctcacaaaaacctcatcaatcacaaccatgggttcaacaggtgaaactcaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2155 - DNA, 359 bp, Artificial
  MsCOMT deletion introduced by TALEN pair MsCOMT_T01.1
tctcacaaaaacctcatcaatcacaaccatgggttcaacaggtgaaactcaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2156 - DNA, 359 bp, Artificial
  MsCOMT deletion introduced by TALEN pair MsCOMT_T01.1
tctcacaaaaacctcatcaatcacaaccatgggttcaacaggtgaaactcaaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2157 - DNA, 359 bp, Artificial
  MsCOMT deletion introduced by TALEN pair MsCOMT_T01.1
tctcacaaaaacctcatcaatcacaaccatgggttcaacaggtgaaactcaaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2158 - DNA, 359 bp, Artificial
  MsCOMT deletion introduced by TALEN pair MsCOMT_T01.1
tctcacaaaaacctcatcaatcacaaccatgggttcaacaggtgaaactcaaccacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2159 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2160 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2161 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2162 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2163 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2164 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2165 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2166 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2167 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagacttgatggtttggctactgttgctaa

SEQ ID NO: 2168 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2169 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2170 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2171 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2172 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggctcagagactttatggtttggctactgttgctaa

SEQ ID NO: 2173 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2174 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2175 - DNA, 355 bp, Artificial
  MsCOMT deletion introduced by TALEN pair MsCOMT_T01.1
tctcacaaaaacctcatcaatcacaaccatgggttcaacaggtgaaactcaaccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2176 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcatattaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2177 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2178 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2179 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 2180 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2181 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagattaagaagcaaacctcttcgccatgcaactatcaagtgcttcagttcttcccatgattttaaaatcagctcttgaacttgatctcttagaaataattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2182 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2183 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 2184 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2185 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccaattatgttggaccgaatgttgcgtctcttggcttgttacaatatcctcacttgttcagttcgtactcaacaagatggaaagattcagagactttatggtttggctactgttgctaa

SEQ ID NO: 2186 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2187 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2188 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2189 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2190 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2191 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2192 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2193 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2194 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcgaatttcacctattgaaattgcttctcagctaccaactgctaaccctgatgcaccagttatgttggaccgaatgttgcgtctattggcttgttacaatatcctcaattgttcagttcgtacgcaacaagatggaaaggttcagagactttatggtttggctactgttgctaa

SEQ ID NO: 2195 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2196 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2197 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2198 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2199 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 2200 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2201 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2202 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2203 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2204 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2205 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2206 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 2207 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 2208 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 2209 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2210 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2211 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttgggctactgttgctaa

SEQ ID NO: 2212 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 2213 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggcttggctactgttgctaa

SEQ ID NO: 2214 - DNA, 359 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 2215 - DNA, 358 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctagttgctaa

SEQ ID NO: 2216 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcggctcttggcttgttacaatatcctcacttgttcagttcgtactcaacaagatggaaagattcagagactttatggtttggctactgttgctaa

SEQ ID NO: 2217 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2218 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2219 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2220 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2221 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgctgctcagctaccaacaactaaccctgatgcaccagttatgttggaccgaatgttgcgtcacttggcttgttacaatatcctcacttgttcagttcgtacgcaacaagatggaaatgttcagagactttatggtttggctactgttgctaa

SEQ ID NO: 2222 - DNA, 359 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaattcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2223 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagttcctcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2224 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcttcagtccttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2225 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaattagcaagtgcctcagttcttcccatgattttaaaatcagctcttgaacttgatctcttagaaatcactgctaaagctggacctggtgctcaaatttcacctattgaaattgtttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 2226 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 2227 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2228 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2229 - DNA, 358 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgcactgttgctaa

SEQ ID NO: 2230 - DNA, 359 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 2231 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2232 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2233 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2234 - DNA, 359 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggttggctactgttgctaa

SEQ ID NO: 2235 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcctctcttggcttgttacaatatcctcacttgttcagttcgtactcaacaagatggaaaggttcagagactttatggtttggctactgttgctaa

SEQ ID NO: 2236 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtgacaatatcctcacttgttcagttcgtactcaacaagatggaaaggttcagagactttatggtttggctactgttgctaa

SEQ ID NO: 2237 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctga

SEQ ID NO: 2238 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattaaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2239 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2240 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctaaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2241 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 2242 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2243 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2244 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2245 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2246 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2247 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2248 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacctcttcgccatgcaactagcaagtgcatcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2249 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaagcaaacatcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2250 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagatgaagaaacaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2251 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatatcagataaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2252 - DNA, 360 bp, Artificial
  MsCOMT deletion introduced by TALEN pair MsCOMT_T01.1
tctcacaaaaacctcatcaatcacaaccatgggttcaacaggtgaaactcaaccaacccacatagccgatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacgatatcctcacttgttcagttcgtactcaacaagatggaaagattcagagtctttatggtttggcgactgttgctaa

SEQ ID NO: 2253 - DNA, 356 bp, Artificial
  MsCOMT deletion introduced by TALEN pair MsCOMT_T01.1
tctcacaaaaacctcatcaatcacaaccatgggttcaacaggtgaaactcaaccaacatataagatgaagaagcaaacatcttcgacatgcaactagcaacagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2254 - DNA, 352 bp, Artificial
  MsCOMT deletion introduced by TALEN pair MsCOMT_T01.1
tctcacaaaaacctcatcaatcacaaccatgggttcaacaggtgaaactcaacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 2255 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagattaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2256 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2257 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2258 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 2259 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2260 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaattagcaagtgcttcagttcttcccatgattttaaaatcagctcttgaacttgatctcttagaaatcattgctaaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2261 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2262 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2263 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatctaaccctgatgcaccagttatgttggaccgaatgttgcgtctcttggcttgttacaatatcctcacttgttcagttcgtactcaacaagatggaaagtttccgagactttatggtttggctactgttgctaa

SEQ ID NO: 2264 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2265 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2266 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2267 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2268 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2269 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgtttcagttcttcccatgattttgaaatcagctcttgaacttgatctcttagaaatcattgctaaagctggacctggtgctcaaatttcacctattgaaattgcttctcagctaccaacaactaaccgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2270 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcggttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2271 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2272 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2273 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2274 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2275 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2276 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 2277 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2278 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttaagagactttatggtttggctactgttgctaa

SEQ ID NO: 2279 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2280 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2281 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2282 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 2283 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2284 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2285 - DNA, 352 bp, Artificial
  MsCOMT deletion introduced by TALEN pair MsCOMT_T01.1
tctcacaaaaacctcatcaatcacaaccatgggttcaacaggtgaaactcaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2286 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagctgaagaagcaaaccacttagccatgcacttagcaagggcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 2287 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagattaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggacctaatgttgcgtctcttggcttgttacaatatcctcacttgttcagttcgtactcaacaaggtggaaaggttcagagactttatggtttggctactgttgctaa

SEQ ID NO: 2288 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaataagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2289 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaaccttttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2290 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgccactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2291 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2292 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaatagcttcagttcttcccatgattttgaaatcagctcttgaacttgatctcttagaaatcattgctaaagctggacctggtgctctaatttcacctattgaaattgcttctcagctaccaacaactaaccctgattcaccagttatgttggaccgaatgttgcgtctcttggcttgttacaacattctcacttgttcagttcgtactcaacaagatggaatggttcagagactttatggttcggatactgttacgca

SEQ ID NO: 2293 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2294 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2295 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2296 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttaaaatcagctcttgaacttgatctcttagaaattattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2297 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2298 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgctcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2299 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2300 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2301 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2302 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 2303 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2304 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2305 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2306 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2307 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2308 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2309 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2310 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 2311 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2312 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggattgttacaatatcctcacttgttcagttcgtactcaacaagatggaaaggttcagagactttatggtttggctactgttgctaa

SEQ ID NO: 2313 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2314 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2315 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2316 - DNA, 353 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 2317 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttattgtttggctactgttgctaa

SEQ ID NO: 2318 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2319 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2320 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2321 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2322 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2323 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgggttgttacaatatcctcacttgttcagttcgtactcaacaagatggaaaggttcagagactttatggtttggctactgttgctaa

SEQ ID NO: 2324 - DNA, 354 bp, Artificial
  MsCOMT deletion introduced by TALEN pair MsCOMT_T01.1
tctcacaaaaacctcatcaatcacaaccatgggttcaacaggtgaaactcaacacatatcagatgaagaagcaaacctcttcgccatgcaactagcaagtgcttcagttcttccaatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2325 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2326 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2327 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2328 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2329 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2330 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2331 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2332 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2333 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2334 - DNA, 358 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggcactgttgctaa

SEQ ID NO: 2335 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagacttcatggtttggctactgttgctaa

SEQ ID NO: 2336 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2337 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2338 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2339 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2340 - DNA, 358 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagacttatggtttggctactgctgctaa

SEQ ID NO: 2341 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaaagttcagagactttatggtttggctactgttgctaa

SEQ ID NO: 2342 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2343 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 2344 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaagattcagagcctttatggtttggctactgttgctaa

SEQ ID NO: 2345 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2346 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2347 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 2348 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaaggttcagagacttgatggtttggctactgttgctaa

SEQ ID NO: 2349 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2350 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2351 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 2352 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgtctactgttgctaa

SEQ ID NO: 2353 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2354 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagttcttccaatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2355 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaattagcaagtgcttcagatcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcccttgttctgttcgtactcaacaagatggaaaggttcagagactttatggtttggctactgttgctaa

SEQ ID NO: 2356 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctctttaacttgatctcttagaaatcattactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2357 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctgttgctcaaatttcacctattgaaattgcttctcagctaccaacaactaaccctgatgcaccagttatgttggaccgaatgtggcgtctcttggcttgttacaatatcctcacttgttcagttcctactcaacaagatggaaaagttcagagactttatggtttggctactgttgctaa

SEQ ID NO: 2358 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaatttgcttctcagcttccaacaactaaccctgatgcactagtcatgttggaccgaatgttgcgtctcttggcttgttacaatatcctcacttgttcagttcgtactcaacaagatggaaaggttcagagactttatggtttggctactgttgctaa

SEQ ID NO: 2359 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2360 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2361 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2362 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2363 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2364 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatccgcacttgttcagttcgtactcaacaagatggaaaggttcagagactttatggtttggctactgttgctaa

SEQ ID NO: 2365 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2366 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2367 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2368 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 2369 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggcgactgttgctaa

SEQ ID NO: 2370 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacgcaacaagatggaaaggttcagagactttatggtttggctactgttgctaa

SEQ ID NO: 2371 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2372 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2373 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2374 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2375 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2376 - DNA, 359 bp, Artificial
  MsCOMT deletion introduced by TALEN pair MsCOMT_T01.1
tctcacaaaaacctcatcaatcacaaccatgggttcaacaggtgaaactcaacaacccacatatcagatgaagaagcaaacctcttcgccatgcaactagcaagtacttcagttcttcccatgattttgaaatcagctcttaaacttgatctcttagaaatcattgctaaagctggacctggtgctcaaatttcacctattgaaattgcttctcagctaccaaccactaaccctgatgcaccagttatggtggaccgaatgttgcgtctcttggcctgttacaatatcctcccttgttcagttcctactcaaaaagatggaaaagttcagaggctttatggtttggctactgttgctaa

SEQ ID NO: 2377 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2378 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacatgttctgttcgtactcaacaagatggaaaggttcagagactttatggtttggctactgttgctaa

SEQ ID NO: 2379 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2380 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2381 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2382 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2383 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2384 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2385 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2386 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgatattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2387 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2388 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2389 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgtaaaagttcagagactttatggtttggctactgttgctaa

SEQ ID NO: 2390 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2391 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2392 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2393 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2394 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacctggtgctcaaatgtcacctattgaaattgcttctcagctaccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 2395 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttgaaatcagctcttgaacttgatctcttagaaatcattgctaaagctggacatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2396 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2397 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2398 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctaccgttgctaa

SEQ ID NO: 2399 - DNA, 366 bp, Artificial
  MsCOMT deletion introduced by TALEN pair MsCOMT_T01.1
tctcacaaaaacctcatcaatcacaaccatgggttcaacaggtgaaactcaaatttttttaacccacatatcagatgaagaagcaaacctcttcgccatgcaactagcaagtgcttcagttcttcccatgattttaaaaatagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctga

SEQ ID NO: 2400 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatgtcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2401 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2402 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 2403 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2404 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2405 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2406 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtttcaatatcctcacttgttcagttcgtactcaacaagatggaaaggttcagagactttatggtttggctactgttgctaa

SEQ ID NO: 2407 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2408 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaattagcaagtgcttcagttcttcccatgattttgaaatcagctcttgaacttgatctcttagaaatcattgctaaagcaggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2409 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2410 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaattagcaagtgcttcagttcttcccatgattttaaaatcaactcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtgtggctactgttgctaa

SEQ ID NO: 2411 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2412 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2413 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2414 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2415 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2416 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2417 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2418 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2419 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2420 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2421 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2422 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2423 - DNA, 362 bp, Artificial
  MsCOMT deletion introduced by TALEN pair MsCOMT_T01.1
tctcacaaaaacctcatcaatcacaaccatgggttcaacaggtgaaactcaaattcaacccacatatcagatgaagaagcaaacctcttcgccatgcaactagcaagtacttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2424 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacttatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2425 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcggatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2426 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcatatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2427 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgtcatgcaattagcaagagcttcagttcttcccatgattttaaaatcagctcttgaacttgatctcttagaaatcatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2428 - DNA, 359 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacgttgctaa

SEQ ID NO: 2429 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2430 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2431 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2432 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2433 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2434 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2435 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2436 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2437 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcggagactttatggtttggctactgttgctaa

SEQ ID NO: 2438 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2439 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2440 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2441 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgaactgaatgttgcgtctcttggcttgttacaatatcctcacttgttcagttcgtactcaacaagatggaaaggttcagagactttatggtttggctactgttgctaa

SEQ ID NO: 2442 - DNA, 360 bp, Artificial
  MsCOMT deletion introduced by TALEN pair MsCOMT_T01.1
tctcacaaaaacctcatcaatcacaaccatgggttcaacaggtgaaactcaaattacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2443 - DNA, 361 bp, Artificial
  MsCOMT deletion introduced by TALEN pair MsCOMT_T01.1
tctcacaaaaacctcatcaatcacaaccatgggttcaacaggtgaaactcaaattaaccctcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2444 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2445 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2446 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2447 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2448 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2449 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2450 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2451 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2452 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaagatcctcacttgttcagttcgtactcaacaagatggaaaggttcagagtctttatggtttggctactgttgctaa

SEQ ID NO: 2453 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2454 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2455 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaaggttcagagactttatggtttggctactgttgctaa

SEQ ID NO: 2456 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2457 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2458 - DNA, 358 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgcatgttgctaa

SEQ ID NO: 2459 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2460 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2461 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2462 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2463 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2464 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2465 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcatagactttatggtttggctactgttgctaa

SEQ ID NO: 2466 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaaggttcagagactttatggtttggctactgttgctaa

SEQ ID NO: 2467 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2468 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2469 - DNA, 361 bp, Artificial
  MsCOMT deletion introduced by TALEN pair MsCOMT_T01.1
tctcacaaaaacctcatcaatcacaaccatgggttcaacaggtgaaactcaaattaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2470 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagcgcctgcaccgtctccagcgcctgcttgccaccaatattgctggcgatggccaccaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2471 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagcgcctgcaccgtctccagcgcctgcttgccaccaatattgctggcgatggccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2472 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagcgcctgcaccgtctccagcgcctgcttgccaccaatattgctggcgatggccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2473 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 2474 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2475 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2476 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2477 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2478 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2479 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 2480 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcagcaagatggaaaggttcagagactttatggtttggctactgttgctaa

SEQ ID NO: 2481 - DNA, 434 bp, Artificial
  MsCOMT deletion introduced by TALEN pair MsCOMT_T01.1
tctcacaaaaacctcatcaatcacaaccatgggttcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2482 - DNA, 427 bp, Artificial
  MsCOMT deletion introduced by TALEN pair MsCOMT_T01.1
tctcacaaaaacctcatcaatcacaaccatgggttcaacaggtgaaactcaaatgcactacgacatcattccgtggcgttatccagctaagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2483 - DNA, 427 bp, Artificial
  MsCOMT deletion introduced by TALEN pair MsCOMT_T01.1
tctcacaaaaacctcatcaatcacaaccatgggttcaacaggtgaaactcaaatgcactacgacatcattccgtggcgttatccagctaagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2484 - DNA, 427 bp, Artificial
  MsCOMT deletion introduced by TALEN pair MsCOMT_T01.1
tctcacaaaaacctcatcaatcacaaccatgggttcaacaggtgaaactcaaatgcactacgacatcattccgtggcgttatccagctaagcgcgaactgcaatttggagaatggcagcgcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2485 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctcagcgcgaactgcaatttggagaatgtcagcgccacccacatatcagatgaagaagcaaacctcttcgccctgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2486 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctcagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcttcacttgttcagttcgtactcaacaagatggaaagattcagagactttatggtttggctactgttgctaa

SEQ ID NO: 2487 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctcagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2488 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctcagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2489 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2490 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2491 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2492 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2493 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2494 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2495 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2496 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2497 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2498 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2499 - DNA, 427 bp, Artificial
  MsCOMT deletion introduced by TALEN pair MsCOMT_T01.1
tctcacaaaaacctcatcaatcacaaccatgggttcaacaggtgaaactcaaatgcacgacgacatcattccgtggcgttatccagctaagcgcgaactgcaatttggagaatggcagcgcaacccacatatcagatgaagaagcaaacctcttcgccaattaattagcaagtgcttctgttcttaccctgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2500 - DNA, 427 bp, Artificial
  MsCOMT deletion introduced by TALEN pair MsCOMT_T01.1
tctcacaaaaacctcatcaatcacaaccatgggttcaacaggtgaaactcaaatgcaccacgacatcattccgtggcgttatccagctaagcgcgaactgcaatttggagaatggcagcgcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2501 - DNA, 427 bp, Artificial
  MsCOMT deletion introduced by TALEN pair MsCOMT_T01.1
tctcacaaaaacctcatcaatcacaaccatgggttcaacaggtgaaactcaaatgcaccacgacatcattccgtggcgttatccagctaagcgcgaactgcaatttggagaatggcagcgcaacccacatatcagatgaagaagcaaacctcttcgccatgcaattagcaagtgcttcagttcttcccatgattttaaaatcagctcttgaacttgatctcttagaattcattgctaaagctggacctggtgctcaaatttcacctattgaaattgcttctcagctcccaacaactatccctgatgcaccagttatgttggaccgaatgttgcgtctcttggcttgttacaatatcctcacttgttcagttcgtactcaacaagatggaaaagttcagagactttatggtttggcgactgttgctaa

SEQ ID NO: 2502 - DNA, 362 bp, Artificial
  MsCOMT deletion introduced by TALEN pair MsCOMT_T01.1
tctcacaaaaacctcatcaatcacaaccatgggttcaacaggtgaaactcaaatctaacccacatatcagatgaagaagcaaccctcttcgccatgcaattagcaagagcttcagatcttcccatgatttagaaatcacctcttgaacttgatctcttagaaaacattgctaaagatggacctggtgctcaaatttcacctattgaaattgcttctcagctaccaacaactaacccttatgtaccaattatgttggaccgaatgtggcgtctcttggcttgttacaatatcatcactttttcagttcgtactcaacaagatggaaaggttcagagactttatggtgtggctactgtgactaa

SEQ ID NO: 2503 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2504 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2505 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccattcaattagcaagttcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2506 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2507 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2508 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2509 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2510 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttgaaatcagctcttgaacttgatctcttagaaatctttgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2511 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2512 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2513 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2514 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2515 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2516 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaatcctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 2517 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccttgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2518 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2519 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2520 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 2521 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttactatatcctcacttgttcagttcgtactcaacaagatggaaaggttcagagactttatggtttggctactgttgctaa

SEQ ID NO: 2522 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2523 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2524 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgctgcgtctcttggcttgttacaatatcctcacttgttcagttcgtactcaacaagatggaaagattcagagactttatggtttggctactgttgctaa

SEQ ID NO: 2525 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2526 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2527 - DNA, 356 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgtttaa

SEQ ID NO: 2528 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2529 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2530 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2531 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2532 - DNA, 357 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcattgttcagttcgtactcaacaagatggaaaggttcagagactttatggtttggctactgttgctaa

SEQ ID NO: 2533 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 2534 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2535 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaagattcagagactttatggtttggctactgttgctaa

SEQ ID NO: 2536 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2537 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2538 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctgaacctggtgctcaaatttcacctgttcaaattgcttcgcagcttccaacaactaaccctgatgcaccagtcatgttggaccgaatgttgcgtctcttggctttttacaatatcctctcttgttcagttcgtactcaacaagatggaaagattcagagactttatggtttggctactgttgctaa

SEQ ID NO: 2539 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactatcaagttcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 2540 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2541 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2542 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2543 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2544 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaagtcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2545 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2546 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2547 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2548 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2549 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2550 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2551 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2552 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2553 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2554 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2555 - DNA, 357 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 2556 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcaattcgtactcaacaagatggaaaggttcagagactttatggtttggctactgttgctaa

SEQ ID NO: 2557 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggagaagttcagagactttatggtttggctactgttgctaa

SEQ ID NO: 2558 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 2559 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 2560 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2561 - DNA, 357 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgcta

SEQ ID NO: 2562 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattacttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2563 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2564 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2565 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2566 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcatcacttgttcagttcgtactcaacaagatggaaaggttcagagactttatggtttggctactgttgctaa

SEQ ID NO: 2567 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2568 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2569 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccatgaaactaacaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatggtgcgtctcttggcttgttacaatatcctcacttgttcagttcgtactcaacaagatggaaaggttcagagactttatggtttggctactgttgctaa

SEQ ID NO: 2570 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctcttcgccaggcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2571 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaagcaaacctattcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2572 - DNA, 358 bp, Artificial
  MsCOMT deletion introduced by TALEN pair MsCOMT_T01.1
tctcacaaaaacctcatcaatcacaaccatgggttcaacaggtgaaactcaaatcccacatatcagatgaagaaccaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2573 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2574 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagattaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2575 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2576 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccctgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2577 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccctgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactatatggtttggctactgttgctaa

SEQ ID NO: 2578 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2579 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcatgttacaatatcctcacttgttcagttcgtactcaacaagatggaaagattcagagactgtatggtttggctactgttgctaa

SEQ ID NO: 2580 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2581 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2582 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2583 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgcttttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2584 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttgaaatcagctcttgaacttgatctcttagaaatcattgctaaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2585 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2586 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2587 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2588 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 2589 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2590 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggtccgaatgttgcgtctcttggcttgttacaatatcctcacttgttctgttcgtactcaacaagatggaaaggttcagagactttatggtttggctactgttgctaa

SEQ ID NO: 2591 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2592 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttcgctactgttgctaa

SEQ ID NO: 2593 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2594 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2595 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2596 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2597 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 2598 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2599 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactcgcaagtgcttcagttcttcccatgattttgaaatcagctattgaacttgatctcttagaaatcattgctaaagctggaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2600 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactatcaagtgcttcagttcttcccatgcttttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2601 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2602 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttggtctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2603 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2604 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2605 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2606 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2607 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgtttgaccgaatgttgcgtctcttggcttgttacaatatcctcacttgttcagttcgtactcaacaagatggaaagattcagagactttatggtttggctactgttgctaa

SEQ ID NO: 2608 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2609 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2610 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2611 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2612 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2613 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2614 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagcaaacctattcgccatgcaactaacaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2615 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaagaaaacctcttcgccatgcaattagcaagtgcttcagttcttcccatgattttaaaatcagctcttgaacttgatctcttagaaatcattgctaaagctggacctggtgctccaatttcacctcttgaaattgcttctcagttaccctcaactaaccctgatgcaccagttatgttggaccgcatgtttcgtctctttacttgttccaatatcctcacttgttcagttcgtactcaacaagatggaaaccttctacacctttatggtttggctactgttgctaa

SEQ ID NO: 2616 - DNA, 357 bp, Artificial
  MsCOMT deletion introduced by TALEN pair MsCOMT_T01.1
tctcacaaaaacctcatcaatcacaaccatgggttcaacaggtgaaactcaaatccacatatcagatgaagaaacaaacctcttcgccatgcaactatcaagtgcttcagttcttccaatgattttgaaatcagctcttgaacttgatctcttagaaatcattgctaaagctggacctggtgttcatatttcacctattgaaattgcttctcagctcccaacaactaaccctaatgcaccagttatgttggaccgaatgttgcgtctcttggcttgttacaatatcctcccttgttcagttcgtactcaacaagattgaaaggttcagagactttatggtttggctactgttgctaa

SEQ ID NO: 2617 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcggatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggattgttacaatatcctcacttgttcagttcgtactcaacaagatggaaagattcagagactttatggtttggctactgttgctaa

SEQ ID NO: 2618 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagcagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtaaccaacaagatggaaaggttcagagactttatggtttggctactgttgctaa

SEQ ID NO: 2619 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2620 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2621 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2622 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttaaaatcagctcttgaacttgatttcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2623 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcagcaagatggaaaggttcagagactttagggtttggctactgttactaa

SEQ ID NO: 2624 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2625 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2626 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2627 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2628 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2629 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2630 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattagcaagtgcttcagttcttcccacgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2631 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaattaacaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2632 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2633 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 2634 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2635 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2636 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2637 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2638 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2639 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2640 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2641 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2642 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaacttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2643 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaactttatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctctcttgttctgtccgtactcaacaagatggaaaggttcagagactttatggtttggctactgttgctaa

SEQ ID NO: 2644 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgttcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2645 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2646 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2647 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2648 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcgtgttacaatatcctcacttgttctgttcgtactcaacaagatggaaaggttcagagactttatggtttggctactgttgctaa

SEQ ID NO: 2649 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctctcttgttctgttcgtactcaacaggatggaaaagttcagagactttatggtttggctactggtgctaa

SEQ ID NO: 2650 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2651 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactggtgctaa

SEQ ID NO: 2652 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgcactcaacaagatggaaaggttcagagactttatggtttggctactgttgctaa

SEQ ID NO: 2653 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2654 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2655 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2656 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2657 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtttcaatatcctcacttgttcagttcgtactcaacaagatggaaagattcagagactttatggtttggctactgttgctaa

SEQ ID NO: 2658 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 2659 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2660 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcccttggcttgttacaatatcctcacttgttcagttcgtactcaacaagatggaaaggttcagagactttatggtttggctactgttgctaa

SEQ ID NO: 2661 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 2662 - DNA, 363 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaaa

SEQ ID NO: 2663 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2664 - DNA, 358 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaagttcagagactttatggtttggctactgttg

SEQ ID NO: 2665 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2666 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 2667 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 2668 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctaaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2669 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcctgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2670 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttcttcccatcattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2671 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaattagcaagtgcttcagttctccccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 2672 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcattttgtaccgaatgtttcgtctcttgacttgttacaatatcctcacttgttcagttcgtactcaacaagattgaaacattcagagactttatggtttggctactgttgctaa

SEQ ID NO: 2673 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2674 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactgtatggtttggctactgttgctaa

SEQ ID NO: 2675 - DNA, 361 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 2676 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2677 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2678 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2679 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2680 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacatatcagatgaagaagcaaacctcttccccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacgcaacaagatggaaaagttcagagactttatggtttggctactgttgctaa

SEQ ID NO: 2681 - DNA, 362 bp, Artificial
  MsCOMT deletion introduced by TALEN pair MsCOMT_T01.1
tctcacaaaaacctcatcaatcacaaccatgggttcaacaggtgaaactcaaatccaacccacagatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2682 - DNA, 360 bp, Artificial
  MsCOMT deletion introduced by TALEN pair MsCOMT_T01.1
tctcacaaaaacctcatcaatcacaaccatgggttcaacaggtgaaactcaaatcacccacatatcagatgaagaagcaaacctcttcgccatgcaattagcaagagcttcagttcttcccatgattttaaaatcagctcttgaacttgatctcttagaaatcattgctaaagctggacctggtgctcaaattactcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2683 - DNA, 361 bp, Artificial
  MsCOMT deletion introduced by TALEN pair MsCOMT_T01.1
tctcacaaaaacctcatcaatcacaaccatgggttcaacaggtgaaactcaaatcaaccgacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2684 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2685 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcatatgaagaagcaaacctctccgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2686 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagttgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2687 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2688 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagatgcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2689 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagtaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2690 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccgtgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 2691 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2692 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2693 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2694 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2695 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2696 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2697 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2698 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2699 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2700 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcgtggcttgttacaatatcctcacttgttctgttcgtactcaacaagatggaaaggttcagagactttatggtttggctactgttgctaa

SEQ ID NO: 2701 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 2702 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcttgaacttgatcccttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2703 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttgaaatcagctcctgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2704 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttataaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2705 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2706 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2707 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggaccttgtggtcaaatttcacctattgaaattgcttctcagctcccaacaactaaccctgatgcaccagttatgttggaccgaatattgcgtctcttggcttgttacaatatcctctcttgttcagttcgtactcaacaagatggaaaggttcagagactttatggtttgcctactggtgctaa

SEQ ID NO: 2708 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcccctattgaaattgcttctcagctaccaacaactaaccctgatgcaccagttatgttggaccgaatgttgagtctcatggcatgttacaatatgctcacttgttcaggtcgtactcaacaagatggaaagattcagagactttatggtctggatactgtagctaa

SEQ ID NO: 2709 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2710 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2711 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 2712 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2713 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2714 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2715 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2716 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2717 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 2718 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2719 - DNA, 360 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtaatcaacaagatggaaaggttcagagactttatggtttgctactgttgctaa

SEQ ID NO: 2720 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacttaacaagatggaaaggttcagagactttatggtttggctactgttgctaa

SEQ ID NO: 2721 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2722 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctcgttacaatatcctcacttgttcagttcgtactcaacaagatggaaagattcagagactttatggtttggctactgttgctaa

SEQ ID NO: 2723 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2724 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactctatggtttggctactgttgctaa

SEQ ID NO: 2725 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 2726 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2727 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2728 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2729 - DNA, 359 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtgcagagactttatggtttggctactggctaa

SEQ ID NO: 2730 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatttcctcacttgttcatttcgtactcaacaagatggaaaggttcagagcctttatggtttggctactgttgctaa

SEQ ID NO: 2731 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2732 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2733 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 2734 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2735 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaagtccttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2736 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaattagcaaatgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2737 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2738 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttctgttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttttgctactgttgctaa

SEQ ID NO: 2739 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcggctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2740 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttggtctcttagaaatcactgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2741 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 2742 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2743 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2744 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2745 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2746 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 2747 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2748 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 2749 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2750 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaatttgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2751 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2752 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2753 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2754 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2755 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2756 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactagttcagttcgtactcaacaagatggaaagattcagagactttatggtttggctactgttgctaa

SEQ ID NO: 2757 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 2758 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2759 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatccccacttgttcagttcgtactcaacaagatggaaaggttcagagactttatggtttggctactgttgctaa

SEQ ID NO: 2760 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagtgactttatggtttggctactgttgctaa

SEQ ID NO: 2761 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagcgactttatggtttggctactgttgctaa

SEQ ID NO: 2762 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaataactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2763 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2764 - DNA, 360 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcta

SEQ ID NO: 2765 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2766 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2767 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactattgctaa

SEQ ID NO: 2768 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 2769 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggctcagagactttatggtttggctactgttgctaa

SEQ ID NO: 2770 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctac

SEQ ID NO: 2771 - DNA, 360 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttatgttcgtactcaacaagatggaaaggttcagagactttatggtttggcactgttgctaa

SEQ ID NO: 2772 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2773 - DNA, 360 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 2774 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcccttggcttgttacaatatcctcacttgttcagttcgtactcaacaagatggaaaagttcagagactttatggtttggctactgttgctaa

SEQ ID NO: 2775 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 2776 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagggactttatggtttggctactgttgctaa

SEQ ID NO: 2777 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtttagagactttatggtttggctactgttgctaa

SEQ ID NO: 2778 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctcggcttgttacaatatcctcacttgttcagttcgtactcaacaagatggaaagattcagagactttatggtttggctactgttgctaa

SEQ ID NO: 2779 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2780 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 2781 - DNA, 360 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctacgttgctaa

SEQ ID NO: 2782 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgaaccagttatgttggaccgaatgttgcgtctcttggcttgttacaatatcctcacttgttcagttcgtactcaacaagatggaaaggttcagagactttatggtttggctactgttgctaa

SEQ ID NO: 2783 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2784 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2785 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggaccaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2786 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2787 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcaatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2788 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatcgcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2789 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgacctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2790 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2791 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2792 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 2793 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2794 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2795 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2796 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2797 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcctaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2798 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2799 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2800 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttggtctgttcgtactcaacaagatggaaaggttcggagactttatgggttggctactgttgctaa

SEQ ID NO: 2801 - DNA, 362 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacctgttgctaa

SEQ ID NO: 2802 - DNA, 362 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaac

SEQ ID NO: 2803 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2804 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2805 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2806 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaattttgcgtctcttggcttgttacaatatcctcacttgttcagttcgtactcaacaagatggaaaggttcagagactttatggtttggctactgttgttaa

SEQ ID NO: 2807 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2808 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2809 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2810 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcccatgactttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2811 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcttcagttcttcacatgattttgaaatcagctcttgaacttgatctcttagaaatcattgctaaagctggaccttgtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 2812 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactagcaagtgcgtcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2813 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2814 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2815 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2816 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaaactcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2817 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagcaaaactcttcgccatgcaactagcaagtgcttcagttcttcccatgattttaaaatcagctcttgaacttgatctcttagaaatcattactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2818 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaagaaaacctcttcgccatgcaattagcaagtgcttcagttcttcccatgattttaaaatcagctcttgaacttgatctcttataaatcattgctaaagctagacctggtgctcaaatttcacctattgaaattgcttctcagctcccaacacctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2819 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacatatcagatgaagaaacaaacctcttcgccatgcaattagcaaatccttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2820 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacataccagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2821 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccacacatcagatgaagaagcaaacctcttcgccatgcaattagcaaatgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2822 - DNA, 361 bp, Artificial
  MsCOMT deletion introduced by TALEN pair MsCOMT_T01.1
tctcacaaaaacctcatcaatcacaaccatgggttcaacaggtgaaactcaaatcaacccaaatatcagatgaagaagcaaacctcttcgccatgcaattagaaaggccttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2823 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccattcaattagcaagtgcttcagttcttcccatgattttaaaatcatctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2824 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2825 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2826 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2827 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2828 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2829 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2830 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2831 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2832 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2833 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcggctcttggcttgttacaatatcctcacttgttcagttcgtactcaacaagatggaaaggttcagagactttatggtttggctactgttgctaa

SEQ ID NO: 2834 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2835 - DNA, 363 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgcactgttgctaa

SEQ ID NO: 2836 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2837 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2838 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2839 - DNA, 379 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcttggctactgttgctaa

SEQ ID NO: 2840 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2841 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2842 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2843 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2844 - DNA, 365 bp, Artificial
  MsCOMT deletion introduced by TALEN pair MsCOMT_T01.1
tctcacaaaaacctcatcaatcacaaccatgggttcaacaggtgaaactcaaatatttaaacccacatatcagatgaagaagcaaacctcttcgccatcaaattagcaagggcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2845 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaatcctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2846 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccctgcaattagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2847 - DNA, 352 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaggttcagagactttatggtttggctactgttgctaac

SEQ ID NO: 2848 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2849 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2850 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttccgagcctttacggtttggctactgttgctaa

SEQ ID NO: 2851 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2852 - DNA, 350 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 2853 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2854 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2855 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2856 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2857 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2858 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2859 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2860 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2861 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaccaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2862 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2863 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgagtctcttggcttgttacaatatcctcacttgttcagttcgtactcaacaagatggaaaagttcagagactttatggtttggctactgttgctaa

SEQ ID NO: 2864 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2865 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2866 - DNA, 351 bp, Artificial
  MsCOMT deletion introduced by TALEN pair MsCOMT_T01.1
tctcacaaaaacctcatcaatcacaaccatgggttcaacaggtgaaactcaaatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2867 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagctgaagaagcaaacctcttcgccatgcaactagcaagtacttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2868 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgcagaagcaaaactcttcgccatgcaactagcaagcgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2869 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaatcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2870 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaatcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2871 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccgtgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2872 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcatcagttatgttggaccgaatgttgcgtctcttggcttgttacaatatcctcacttgttcagttcgtactcaacaagatggaaagattcagagactttatggtttggctactgttgctaa

SEQ ID NO: 2873 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2874 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2875 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2876 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2877 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttgcaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2878 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2879 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2880 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2881 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcatcagttatgttggaccgaatgttgcgtctcttggcttgttacaatatcctcacttgttcagttcgtactcaacaagatggaaaagttcagagactttatggtttggctactgttgctaa

SEQ ID NO: 2882 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2883 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2884 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2885 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttcccagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2886 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2887 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2888 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccctgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2889 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2890 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 2891 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2892 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2893 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2894 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2895 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2896 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2897 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2898 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2899 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 2900 - DNA, 341 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttagggtttggcta

SEQ ID NO: 2901 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggacagaatgttgcgtcgcttggcttgttacaatatcctcacttgttcagttcgtactcaacaagatggaaaggttcagagcctttatggtttggctactgttgctaa

SEQ ID NO: 2902 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2903 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2904 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactatcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2905 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2906 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2907 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2908 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2909 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2910 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2911 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcagatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2912 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 2913 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2914 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2915 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2916 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2917 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 2918 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 2919 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcacctgttatgttggaccgaatgttgcgtctcttggcttgttacaatatcctcacttgttcagttcgtactcaacaagatggaaaggttcagagactttatggtttggctactgttgctaa

SEQ ID NO: 2920 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2921 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2922 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2923 - DNA, 350 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 2924 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaagttcagagactttatggtttggctactgttgctaa

SEQ ID NO: 2925 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 2926 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2927 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2928 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2929 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2930 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2931 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2932 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtgcttcagttcttcccatgattttaaaatcagctcttgaacttgatctcttagaaataattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2933 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctcttcgccatgcaactagcaagtccttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtcacaatatcttcacttgttcagttcgtactcaacaagatggaaaagttcagagactttatggtttggctactgttgctaa

SEQ ID NO: 2934 - DNA, 351 bp, Artificial
  MsCOMT deletion introduced by TALEN pair MsCOMT_T01.1
tctcacaaaaacctcatcaatcacaaccatgggttcaacaggtgaaactcaaatatcagatgaagaagcaaacctattcgccctgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2935 - DNA, 351 bp, Artificial
  MsCOMT deletion introduced by TALEN pair MsCOMT_T01.1
tctcacaaaaacctcatcaatcacaaccatgggttcaacaggtgaaactcaaatatcacatgaagaatcaaacctcttcgccatgcaattagcaaatgcttcagttcttcccatgattttaaaatcagctcttgaacttgatctcttagaaatcatttctaaagctggacctggtgctcaaatttcacctattgaaattgcttctcagctcccaacaactaaccctgatgcaccagttatgttggaccgaatgttgcgtctattggcttgttacaatatcctcacttgttcagttcgtactcaacaagatggaaagattcagagactttatggtttggctactgttactaa

SEQ ID NO: 2936 - DNA, 353 bp, Artificial
  MsCOMT deletion introduced by TALEN pair MsCOMT_T01.1
tctcacaaaaacctcatcaatcacaaccatgggttcaacaggtgaaactcaaatatatcagatgaagaagcaaacctcttcgccatgcccttagcaagtgcttcagttcttcccatgattatgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2937 - DNA, 353 bp, Artificial
  MsCOMT deletion introduced by TALEN pair MsCOMT_T01.1
tctcacaaaaacctcatcaatcacaaccatgggttcaacaggtgaaactcaaatatatcagatgaagaagcaaacctcttcgccatgcaattagcaattgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 2938 - DNA, 353 bp, Artificial
  MsCOMT deletion introduced by TALEN pair MsCOMT_T01.1
tctcacaaaaacctcatcaatcacaaccatgggttcaacaggtgaaactcaaatatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2939 - DNA, 353 bp, Artificial
  MsCOMT deletion introduced by TALEN pair MsCOMT_T01.1
tctcacaaaaacctcatcaatcacaaccatgggttcaacaggtgaaactcaaatatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2940 - DNA, 353 bp, Artificial
  MsCOMT deletion introduced by TALEN pair MsCOMT_T01.1
tctcacaaaaacctcatcaatcacaaccatgggttcaacaggtgaaactcaaatatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2941 - DNA, 353 bp, Artificial
  MsCOMT deletion introduced by TALEN pair MsCOMT_T01.1
tctcacaaaaacctcatcaatcacaaccatgggttcaacaggtgaaactcaaatatatcagatgaagaagcaaacctcttcgccatgcaattagcaagtgcttcagttcttcccatgattttaaaatcagctcttgaactttatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2942 - DNA, 353 bp, Artificial
  MsCOMT deletion introduced by TALEN pair MsCOMT_T01.1
tctcacaaaaacctcatcaatcacaaccatgggttcaacaggtgaaactcaaatatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2943 - DNA, 353 bp, Artificial
  MsCOMT deletion introduced by TALEN pair MsCOMT_T01.1
tctcacaaaaacctcatcaatcacaaccatgggttcaacaggtgaaactcaaatatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2944 - DNA, 353 bp, Artificial
  MsCOMT deletion introduced by TALEN pair MsCOMT_T01.1
tctcacaaaaacctcatcaatcacaaccatgggttcaacaggtgaaactcaaatatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2945 - DNA, 353 bp, Artificial
  MsCOMT deletion introduced by TALEN pair MsCOMT_T01.1
tctcacaaaaacctcatcaatcacaaccatgggttcaacaggtgaaactcaaatatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2946 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccggtagcggatttgaccgttgtgaagcaacgtcccggagggtggcgggcgtaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2947 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccggtagcggatttgaacgttgtgaagcaacggcccggagggtggcgggcgtaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2948 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaccgttgtgaagcaacttcccggagggtggcgggcgtaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2949 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaccgttgtgaagcaactgcccggagggtggcgggcgtaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2950 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaccgtggtgaagcaacggcccggagggtggcgggcgtaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2951 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaacgttgtgaagcaactgcccggagggtggcgggcgtaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2952 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaacgttgtgaagcaacggcccggagggtggcgggcgtaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2953 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaacgttgtgaagcaacggcccggagggtggcgggcgtaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2954 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaacgttgtgaagcaacggcccggagggtggcgggcgtaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2955 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaacgttgtgaagcaacggcccggagggtggcgggcgtaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2956 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaacgttgtgaagcaacggcccggagggtggcgggcgtaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 2957 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaacgttgtgaagcaacggcccggagggtggcgggcgtaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 2958 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaacgttgtgaagcaacggcccggagggtggcgggcgtaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2959 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaacgttgtgaagcaacggcccggagggtggcgggcgtaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2960 - DNA, 424 bp, Artificial
  MsCOMT deletion introduced by TALEN pair MsCOMT_T01.1
tctcacaaaaacctcatcaatcacaaccatgggttcaacaggtgaaactcaaataggacaaatccgccgggagcggatttgaacgttgtgaagcaacggcccggagggtggcgggcgtaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2961 - DNA, 420 bp, Artificial
  MsCOMT deletion introduced by TALEN pair MsCOMT_T01.1
tctcacaaaaacctcatcaatcacaaccatgggttcaacaggtgaaactcaaatagcctgtgctgtgccaggcccacggcttgaccccggagcaggttgtggccatcgccagccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2962 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgtcaggcccacggcttgaccccggagcaggtggtggccatcgccagccaacccacatatcagatgaagaagcaaacctcttcgccatgcaaatagcaagggcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2963 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggatcaggtgttggccatcgccagccaaccaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaaccactatccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 2964 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggagcaggtggtggccatcgccagccaacccacatatcagatgaagaagcaaacctcttcgccatgcaattagcaggtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2965 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggagcaggtggtggccatcgccagccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2966 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggagcaggtggtggccatcgccagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2967 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggagcaggtggtggccatcgccagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 2968 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggagcaggtggtggccatcgccagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2969 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggagcaggtggtggccatcgccagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 2970 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggagcaggtggtggccatcgccagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2971 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggagcaggtggtggccatcgccagccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 2972 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggagcaggtagtggccatcgccagccaacccacatatcagatgaagaagcaaacctcttcgccatgcaactagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2973 - DNA, 420 bp, Artificial
  MsCOMT deletion introduced by TALEN pair MsCOMT_T01.1
tctcacaaaaacctcatcaatcacaaccatgggttcaacaggtgaaactcaaatagccggtgctgtgccaggcccacggcttgaccccggagcaggcgggggccatccccagccaacccacctatcagatgaagaaacaaacctcttcgccatgcaactatcaaatgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2974 - DNA, 359 bp, Artificial
  MsCOMT deletion introduced by TALEN pair MsCOMT_T01.1
tctcacaaaaacctcatcaatcacaaccatgggttcaacaggtgaaactcaaatacccgcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2975 - DNA, 358 bp, Artificial
  MsCOMT deletion introduced by TALEN pair MsCOMT_T01.1
tctcacaaaaacctcatcaatcacaaccatgggttcaacaggtgaaactcaaataccccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2976 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatgtcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2977 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2978 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2979 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgtagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2980 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatggagaagcaaacctcttcgccgtgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2981 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatggagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2982 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgatgaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2983 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgacgaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2984 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaatcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2985 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaatcaaacctcttcgccatgcaattagcaagtgcttcagttcttcccatgatttaaaatcagctcttgaacttgatctcttagaaatcattgctaaagctggacctggtgctcaaatttcacctgttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2986 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaatcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2987 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaatcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2988 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaatcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccaggtatgttggaccgaatgttgcgtcacttggcttgttacaatatcctcacttgttcagttcgtactcaacaagatggaaaagttcagagactttatggtttggctactgttgctaa

SEQ ID NO: 2989 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagtaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 2990 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaacctcttccccattcaattaggaaatggttcagttcttcccatgattttaaaatcagcttttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2991 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaaggttcagagacttgatggtttggctactgttgctaa

SEQ ID NO: 2992 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgtcatgcaactagcaagtgcttcatttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacggttgctaa

SEQ ID NO: 2993 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgtcatgcaactagcaagtacttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2994 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcggcatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2995 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccttgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2996 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccttgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 2997 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcagctagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 2998 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattggcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagggactttatggtttggctactgttgctaa

SEQ ID NO: 2999 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcgagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3000 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3001 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3002 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgtttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3003 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcggttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3004 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcatttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3005 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcatttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 3006 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcatttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3007 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcatttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3008 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccgtgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3009 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgatttttaaatcagcttttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactggttcagttcgtactcaacaagatggaaaagttcagagactttatggtttggctactgttgctaa

SEQ ID NO: 3010 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtcgctaa

SEQ ID NO: 3011 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3012 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3013 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3014 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3015 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 3016 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgtaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3017 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcatctaccaacatctaaccctgatgcaccagttatgttggaccgaatgtggcgtctcttggcctgttacaatatcctcacttgttcagttcgtactcaacaagatggaaagattcagagactttatggtttggctactgttgctaa

SEQ ID NO: 3018 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3019 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3020 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3021 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 3022 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttccaatatcctcacttgttcagttcgtaatcaacaagatagaaaggttcagagactttatggtttggctactgttgctaa

SEQ ID NO: 3023 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgtctactgttgctaa

SEQ ID NO: 3024 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 3025 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggatactgttgctaa

SEQ ID NO: 3026 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 3027 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3028 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3029 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacccttatgcaccagttatgttggaccgaatgttgcgtctcttggcttgttacaatatcctctcttgttcagttcgtactcaacaagatggaaaggttcagagactttatggtttggctactgttgctaa

SEQ ID NO: 3030 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3031 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3032 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3033 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatattgcgtctcttggctggttacaatatcctcacttgttcagttcgtacgcagcaagatggaaaagttcagagactttatggtttcgctactgttgctaa

SEQ ID NO: 3034 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcaattcgtactcaacaagatggaaaagttcagagactttatggtttggctactgttgctaa

SEQ ID NO: 3035 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3036 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 3037 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3038 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatcccttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3039 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgacctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3040 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttcatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3041 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctctttaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3042 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaatttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3043 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaatttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3044 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttataaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3045 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagacatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3046 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcatttctaaagctggacctgtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3047 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcatttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3048 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggttctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3049 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcgaatttcacctgttcaaattgcttctcagcttccaacaactaaccctgatgcaccagtcatgttggaccgaatgtagcgtctcttggcttgttacaatatcctcacttgttctgttcgtactcaacaagatggaaaggttcagagactttatggtttggctactgttgctaa

SEQ ID NO: 3050 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatggaaaggttcagagtttttatggtttggatactggtgctaa

SEQ ID NO: 3051 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcagctattgaaattgcttctcagctcccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 3052 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcggcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 3053 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3054 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 3055 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3056 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 3057 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 3058 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3059 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3060 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3061 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3062 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 3063 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 3064 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3065 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3066 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3067 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3068 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3069 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3070 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3071 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3072 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3073 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3074 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3075 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3076 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcccacttgttcagttcgtactcaacaagatggaaaagttcagagactttatggtttggctactgttgctaa

SEQ ID NO: 3077 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccgaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3078 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccctacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3079 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3080 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3081 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaagattcagagactttatggtttggctactgttgctaa

SEQ ID NO: 3082 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3083 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3084 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 3085 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3086 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3087 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttaaggtttggctactgttgctaa

SEQ ID NO: 3088 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtgtggctactgttgctaa

SEQ ID NO: 3089 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatccccacttgttcagttcgtactcaacaagatggaaaggttcagagactttatggtttggctactgttgctaa

SEQ ID NO: 3090 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagattttatggtttggctactgttgctaa

SEQ ID NO: 3091 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 3092 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttgtggtttggctactgttgctaa

SEQ ID NO: 3093 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 3094 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcttactcaacaagatggaaaggttcagagactttatggtttggctactgttgctaa

SEQ ID NO: 3095 - DNA, 360 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgggttggctactgttgctaac

SEQ ID NO: 3096 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaacatcctcacttgttcagttcgtactcaacaagatggaaagattcagagactttatggtttggctactgttgctaa

SEQ ID NO: 3097 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 3098 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 3099 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctattgttgctaa

SEQ ID NO: 3100 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactggttcagttcgtactcaacaagatggaaaggttcagagactttatggtttggctactgttgctaa

SEQ ID NO: 3101 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaagattcagagactttatggtttggctactgttgctaa

SEQ ID NO: 3102 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 3103 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 3104 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 3105 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 3106 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 3107 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatagtttggctactgttgctaa

SEQ ID NO: 3108 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcatggcttgttacaatatcctcacttgttcagttcgtactcaacaagatggaaaggttcagagactttatggtttggctactgttgctaa

SEQ ID NO: 3109 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 3110 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatcgaaagattcagagactttatggtttggctactgttgctaa

SEQ ID NO: 3111 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaaggttcagagactttatggtttggctactgttgctaa

SEQ ID NO: 3112 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaggttcagagactttatggtttggctactgttgctaa

SEQ ID NO: 3113 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 3114 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctctgggcgtgttacaatatcctcacttgttcagttcgtactcaacaagatggaaaggttcagagactttatggtttggctactggtgctaa

SEQ ID NO: 3115 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtatggctactgttgctaa

SEQ ID NO: 3116 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatattggaccgaatgttgcgtctcttggcttgttacaatatcctcacttgttctgttcgtactcaacaagatggaaaggttcagagactttatggtttggctactgttgctaa

SEQ ID NO: 3117 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttacgttggaccgaatgttgcgtctcttggcttgttacaatatcctcacttgttcagttcgtactcaacaagatggaaaggttcagagactttatggtttggctactgttgctaa

SEQ ID NO: 3118 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3119 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 3120 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3121 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtatgttggaccgaatgttgcgtctcttggcttgttacaatatcctcacttgttcagttcgtactcaacaagatggaaaggttcagagactttatggtttggctactgttgctaa

SEQ ID NO: 3122 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatacaccagttatgttggaccgaatgttgcgtctcttggcttgttacaatatcctcacttgttcagttcgtactcaacaagatggaaagattcagagactttatggtttggctactgttgctaa

SEQ ID NO: 3123 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgacgcaccagttatgttggaccgaatgttgcgtctcttggcttgttacaatatcctcacttgttcagttcgtactcaacaagatggaaagattcagagactttatggtttggctactgttgctaa

SEQ ID NO: 3124 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3125 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagctaaccctgatgcaccagttatgttggaccgaatgttgcgtctcttggcttgttacaatatcctcacttgttcagttcgtactcaacaagatggaaaagttcagagactgtatggtttggatactgttgctaa

SEQ ID NO: 3126 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctctcttgttcagtacgtactcaacaagatggaaaggttcagagactttatggtttggctactgttgctaa

SEQ ID NO: 3127 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3128 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3129 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3130 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3131 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgcta

SEQ ID NO: 3132 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 3133 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagaggctttatggtttggctactgttgctaa

SEQ ID NO: 3134 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 3135 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 3136 - DNA, 357 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtcctcaacaagatggaaaggttcagagactttatggtttggctagttgctaa

SEQ ID NO: 3137 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaagattcagagactttatggtttggctactgttgctaa

SEQ ID NO: 3138 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 3139 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 3140 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagggactttatggtttggctactgttgctaa

SEQ ID NO: 3141 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 3142 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 3143 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaaagttcagagactttatggtttggctactgttgctaa

SEQ ID NO: 3144 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 3145 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtattcaacaagatggaaaggttcagagactttatggtttggctactgttgctaa

SEQ ID NO: 3146 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 3147 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttctaa

SEQ ID NO: 3148 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtccagttcgtactcaacaagatggaaaagttcagagactttatggtttggctactgttgctaa

SEQ ID NO: 3149 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgctggaccgaatgttgcgtctcttggcttgttacaatatcctcacttgttcagttcgtactcaacaagatggaaaagttcagagactttatggtttggctactgttgctaa

SEQ ID NO: 3150 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3151 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3152 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcctctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3153 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatcgcttctcagctcccaacaactaaccctgatgcaccagttatgttggaccgaatgttgcgtctctttgcttgttacaatatcctcacttgttcagttcgtactcaacaagatggaaagattcagagactttatggtttggctactgttgctaa

SEQ ID NO: 3154 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3155 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacatgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3156 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaattacacctattgaaattgcttctcagctcccaacaactaaccctgatgcaccagttatgttggaccgaatgttgcatctcttggcttgttacaatatcctcacttgttcagttcgtacacaacaagatgaaaaagttcagagactttatggtttggctactgttgctaa

SEQ ID NO: 3157 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaacttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctat

SEQ ID NO: 3158 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaacttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3159 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggcgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3160 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3161 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctcccaacaactaaccctgatgcaccagttatgttggaccgaatgttgcgtctcttggctcgttacaatatcctcacttgttcagttcgtactcaacaagatggaaagattcagagactttatggtttggctactgttgctaa

SEQ ID NO: 3162 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattcctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3163 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttaaaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3164 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctctcagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3165 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcagcacttgaacttgatctcttagaaatcattgctaaagctggacctggtgctcaaatttcacctttttaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3166 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaatcaactcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3167 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaaccagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagatccagagactttatggtttggctactgttgctaa

SEQ ID NO: 3168 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattttaaaaccagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3169 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgatttcaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 3170 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgatttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3171 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattgtaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3172 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgattataaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3173 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagttcttcccatgatcttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3174 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtgcttcagctcttcccatgattttaaaatcagctcttgaacttgatctcttagaaatcattgctaaagctggacctggtgctcaaatttcacctattgaaattgcttctcagctcccaacaactaaccctgatgcaccagttattttggaccgaatgttgcgtctcttggcttgttacaatatcctcacttgttcagttcgtacccaacaagatggaaaggttcagagcctttatggtttggctactgttgctaa

SEQ ID NO: 3175 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtacttcagttcttcccatgattttaaaatcagctcttaaacttgatctcttagaaatcattgctaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3176 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaagtacttcagttcttcccatgatttcaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3177 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagcaaatgcttcagatcttcccatgattttaaaatcagctcttgaacttgatctcttagacatcattgctaaagctggacctggtgctcaaatttcacctattgaaattgcttctcagctcccaacaactgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3178 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattagaaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3179 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3180 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagtaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 3181 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagcttcagagtctttatggtttggctactgttgctaa

SEQ ID NO: 3182 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 3183 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagttcttcagttcttccaatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3184 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcatttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3185 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttggaatcagctcttgaacttgatctcttagcacgcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagaatttatggtttggctactgttgctaa

SEQ ID NO: 3186 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcggctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3187 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctctttaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaacgttcagagactttatggtttggctactgttgctaa

SEQ ID NO: 3188 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctctttaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3189 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctctttaacttgatctcttagaaatcattgctaaagctggacctggtgcacaaatttcacctattgaaattgcttctcagctaccaacaactaaccctgatgcaccagttatgttggaccgaatgttgcgtctcttggcttgttacaatttcctcacttgttcagttcgtactcaacaagatggaaagattcagagactttatggtttggctactgttgctaa

SEQ ID NO: 3190 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagacatcattgctaaagctggacctggtgctcaagtttcacctattgaaattgcttctcagctaccaacaactaaccctgatgcaccagttatgttttaccgaatgcttcgtcacttggcttgttacaataacctcacttgttcagttcgtactcaaccagatggaaagattcagagcccttatgatttggctactgttactaa

SEQ ID NO: 3191 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaattcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3192 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaagtcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3193 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3194 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctagagctggacctggtgctcaaattcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3195 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3196 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgcttaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3197 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctctaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3198 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgttctcaacaagattgaaaggttcagagactttatggtttggctactgttgctaa

SEQ ID NO: 3199 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3200 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3201 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3202 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 3203 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3204 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3205 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttgaaccgaatgttgcgtctcttggcttgttacaatatcctcacttgttcagttcgtactcaacaagatggaaagattcagagactttatggtttggctactgttgctaa

SEQ ID NO: 3206 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3207 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3208 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3209 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttcgcagcttccaacaactaaccctgatgcaccagtcatgttggaccgaatgttgcgtctcttggcttgttacaatttcctcacttgttctgttcgtactaaacaagatggaaaggttcagagactttatggtttggctactgttgctaa

SEQ ID NO: 3210 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3211 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 3212 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3213 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgccaacaactaaccctgatgcaccagttatgttggaacgaatgttgcgtcactaagcttgttacaatatccacacttgttcagttcgtgatcaacaatacagaaaggttcagagactttatgtgttggcgactgttgctaa

SEQ ID NO: 3214 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagaactaaccctgatgcaccagttatgttggaccgaatgttgcgtctcttggcttgttacaatatcctcacttgttcagttcgtactcaacaagatggaaaagttcagagactttgtggtttggctactgttgctaa

SEQ ID NO: 3215 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3216 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3217 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3218 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaacgttcagagactttatggtttggctactgttgctaa

SEQ ID NO: 3219 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcatactcaacaagatggaaaggttcagagactttatggtttggctactgttgctaa

SEQ ID NO: 3220 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3221 - DNA, 355 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtaa

SEQ ID NO: 3222 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatttcctcacttgttcagttcgtactcaacaagatggaaagattcagagactttatggtttggctactgttgctaa

SEQ ID NO: 3223 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 3224 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgaaaagattcagagactttatggtttggctactgttgctaa

SEQ ID NO: 3225 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccagatggaaaagttcagagactttatggtttggctactgttgctaa

SEQ ID NO: 3226 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 3227 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttaaggtttggctactgttgctaa

SEQ ID NO: 3228 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 3229 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 3230 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgttctcaacaagatggaaaagttcagagactttatggtttggctactgttgctaa

SEQ ID NO: 3231 - DNA, 360 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttttggctactgttgctaa

SEQ ID NO: 3232 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgttcccaacaaaaaggaaaggttcagaggctttaatgtttggctactggtgctaa

SEQ ID NO: 3233 - DNA, 357 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgggttggcactgttctaa

SEQ ID NO: 3234 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagacttatggtttggctactgttgctaa

SEQ ID NO: 3235 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3236 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3237 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctactaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3238 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaattaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3239 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 3240 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 3241 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttgtgttggaccgaatgttgcgtctcttggcttgttacaatatcctcacttgttcagttcgtactcaacaagatggaaaggttcagagactttatggtttggctactgttgctaa

SEQ ID NO: 3242 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgtttgaccgaatgttgcgtctcttggcttgttacaatatcctcacttgttcagttcgtactcaacaagatggaaaagttcagagcctttatggtttggctactgttgctaa

SEQ ID NO: 3243 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3244 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3245 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 3246 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3247 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 3248 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagaaactttatggtttggctactgttgctaa

SEQ ID NO: 3249 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggcactgttgctaa

SEQ ID NO: 3250 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaatgttcagagactttatggtttggctactgttgctaa

SEQ ID NO: 3251 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 3252 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 3253 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3254 - DNA, 360 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactggttgctaa

SEQ ID NO: 3255 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtttcaatatcctcacttgttcagttcgtactcaacaagatggaaaggttcagagactttatggtttggctactgttgctaa

SEQ ID NO: 3256 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactgtatggtttggctactgttgctaa

SEQ ID NO: 3257 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatctcctcacttgttccgttcgtactcaacaagatggaaaggttcagagtctttatggtttggctactgttgctaa

SEQ ID NO: 3258 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacgatatcctcacttgttcagttcgtactcaacaagatggaaaggttcagagactttatggtttggctactgttgctaa

SEQ ID NO: 3259 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttggtaa

SEQ ID NO: 3260 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 3261 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgactcttggcttgttacaatatcctcactttgtcagttcgttctcaaccagatggaaaagttcagagactttatggtttggctactgttgctaa

SEQ ID NO: 3262 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaagttcagagactttatggtttggctactgttgctaa

SEQ ID NO: 3263 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatccccacttgttcagttcgtactcaacaagatggaaaggttcagagactttatggtttggctactgttgctaa

SEQ ID NO: 3264 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 3265 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaaagttgcgtctcttggcttgttacaatatcctcacttgttcagttcgtactcaacaagatggaaagattcagagactttatggtttggctactgttgctaa

SEQ ID NO: 3266 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagacttatggtttggctactgttgctaa

SEQ ID NO: 3267 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgtttggctactgttgctaa

SEQ ID NO: 3268 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 3269 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 3270 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 3271 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaaaatcctcacttgtgcagttcgtactcaacaagatggaaaggttcagagactttatggtttggcgactgttgctaa

SEQ ID NO: 3272 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctacttttgctaa

SEQ ID NO: 3273 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctac

SEQ ID NO: 3274 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctagtgttgctaa

SEQ ID NO: 3275 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaaagttcagagactttatggtttggctactgttgctaa

SEQ ID NO: 3276 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatgatttggctactgttgctaa

SEQ ID NO: 3277 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttagaccgaatgttgcgtctcttggcttgttacaatatcctcacttgttcagttcgtactcaacaagatggaaaagttcagagactttatggtttggctactgttgctga

SEQ ID NO: 3278 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgctggaccgaatgttgcgtctcttggcttgttacaatatcctcacttgttcagttcgtactcaacaagatggaaaggttcagagactttatggtttggctactgttgctaa

SEQ ID NO: 3279 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3280 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3281 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 3282 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatcgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3283 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaactgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3284 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctagtgaaattgcttctcagctaccaacacctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3285 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctagtgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3286 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacatattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3287 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaattccacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3288 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3289 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3290 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggcgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3291 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3292 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgccaaagctggacctggtgctcaaatttcacctattgaaattgcttctcagctcccaacaactaaccctgatgcaccagttatgttggaccgaatgttgcgtctcttggattgttacaatatcctcacttgttcagttcgtactcaacaagatggaaaagttcagagactttatggtttggctactggggctaa

SEQ ID NO: 3293 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3294 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttcaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 3295 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3296 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3297 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttgaaatcagcgcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3298 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttcaaatcagctcttgaacttgatctcttagcaatcattgctaaagctggacctggtgctcaaatttcacctattgagattgcttctcagctaccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 3299 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttacaatcagctcttgaccttgctctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactggttcagttcgtactcaacaagatggaaaggttcagagactttatggtttggctactggtgctaa

SEQ ID NO: 3300 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctctttaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3301 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3302 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3303 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3304 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3305 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3306 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3307 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3308 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctctcttgttcagttcgtactcaacaagatggaaaggttcagagactttatggtttggctactgttgctaa

SEQ ID NO: 3309 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaagattcagagactttatggtttggctactgttgctaa

SEQ ID NO: 3310 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3311 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 3312 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3313 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaattttgcgtctcgttgcttgttacaatatcctcacttgttcagttcgtactcaacaagatggaaagattcagagactttatggtttggctactgttgctaa

SEQ ID NO: 3314 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgggtactgttgctaa

SEQ ID NO: 3315 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3316 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3317 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttggtaa

SEQ ID NO: 3318 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctgctgttgctaa

SEQ ID NO: 3319 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttagcttgttacaatatcctcacttgttcagttcgtactcaacaagatggaaagattcagagactttatggtttggctactgttgctaa

SEQ ID NO: 3320 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3321 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3322 - DNA, 358 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 3323 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3324 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaaagttcagagactttatggtttggctactgttgctaa

SEQ ID NO: 3325 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttggtacaatatcctcacttgttcagttcgtactcaacaagatggaaaggttcagagactttatggtttggctactgttgctaa

SEQ ID NO: 3326 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3327 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctcttagaaatcattgctaaagctagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3328 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattttaaaatcagctcttgaacttgatctctcagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3329 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttcttcccatgattctgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3330 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagttctccccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3331 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcaggtcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 3332 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcttcagctcttcccatgattttgaaatcagctcttgaacttgctctcttagaaatcattgctaaagctggacctggtgcgcaaatttcacctattgaaattgcttcgcagctaccaacaactaaccctgatgcaccagttatgttggaccgaatgttgcgtctcttggcttgttacaatatcctcgcttgttcagttcgtactcaacaagatggaaaggttcagagactttatggtttggctactgttgcgaa

SEQ ID NO: 3333 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgctccagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3334 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcgtcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3335 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagtgcctcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3336 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3337 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatgcaactaccaagtgctccagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3338 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatccaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3339 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaagattcagagactttatggtttggctactgttgctaa

SEQ ID NO: 3340 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3341 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3342 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgccaagcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3343 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcttcgcaatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatttttcgtctcttggcttgttacaatatcctcacttgttcagttcgtactcaacaagatgtaaaagttcagagactttatggtttggctactgttgctaa

SEQ ID NO: 3344 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctctccgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3345 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctctacgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3346 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctcatccccatgcacttagcaagtgcttcaggtcttcccattattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3347 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacctattcgccatgcaattagcaagttcttcagttcttcccatgattttaaaatcagctctttaacttgatctcttagaaatcattgctaaagcttgacctggtgctcaaatttcacctattgaaattgcgtctcagctcccaagcactaaccctgatgcaccatttatgtcggtccgaatgttgcgtctcttggcttgttacaatatcctcacttgttcagttcgtactcaacaagatggaaatgttcacagactttatggtttggatactggtgctaa

SEQ ID NO: 3348 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaagcaaacatcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcttactcaacaagatggaaagattcagagactttatggtttggctactgttgctaa

SEQ ID NO: 3349 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatatcagatgaagaaccaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccggatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3350 - DNA, 359 bp, Artificial
  MsCOMT deletion introduced by TALEN pair MsCOMT_T01.1
tctcacaaaaacctcatcaatcacaaccatgggttcaacaggtgaaactcaaatacccacatataagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaattaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3351 - DNA, 363 bp, Artificial
  MsCOMT deletion introduced by TALEN pair MsCOMT_T01.1
tctcacaaaaacctcatcaatcacaaccatgggttcaacaggtgaaactcaaataccaccccacatctcagctgaagaagcaaacctcttctccatccaactaccaacagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3352 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccattcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 3353 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattatcaagtgcttcagttcttcccatgatttttaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3354 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3355 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3356 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3357 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3358 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3359 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3360 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3361 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3362 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3363 - DNA, 357 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtaatcaacaagatggaaaggttcagagactttatggtttggtactgttgctaa

SEQ ID NO: 3364 - DNA, 357 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgtaa

SEQ ID NO: 3365 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttgaaatcagctcttgaacttgatcacttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3366 - DNA, 357 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3367 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcagatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3368 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3369 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3370 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 3371 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttattgtttggctactgttgctaa

SEQ ID NO: 3372 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3373 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3374 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3375 - DNA, 357 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtaatcaacaagatggaaaggttcagagactttatggtttggcactgttgctaa

SEQ ID NO: 3376 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcaactaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3377 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3378 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3379 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 3380 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3381 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3382 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3383 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 3384 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3385 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgcctactgttgctaa

SEQ ID NO: 3386 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3387 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 3388 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3389 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3390 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3391 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3392 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttaaaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3393 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcttcagttcttcccatgattgtaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 3394 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaattagcaagtgcctcagttcttcccatgattttaaaatcagatcttgaacttgatctcttagaaatcattgctaaagctggacctggtgctctaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3395 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactcgcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3396 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3397 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgcaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3398 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctgttgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaaggttcagagactttatgggttggctactgttgctaa

SEQ ID NO: 3399 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3400 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3401 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3402 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 3403 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 3404 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3405 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3406 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcagcaagatggaaaggttcagaggctttatggtttggctactggggctaa

SEQ ID NO: 3407 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3408 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 3409 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3410 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattggaattgcttctcagctcccaacagctaaccctgatgcaccatttatgttggtccgaattttgcgacacttgacatgttacgaaacccacccttgtgcagtacgtactctaccagagggaaaaattcagagaaataatggtttgtctactgtacctaa

SEQ ID NO: 3411 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3412 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3413 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3414 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3415 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgcttcagttcttcccatgatttcgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3416 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgccatgcaactagcaagtgattcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3417 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcgcaatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3418 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3419 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaagcaaacctattcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 3420 - DNA, 358 bp, Artificial
  MsCOMT deletion introduced by TALEN pair MsCOMT_T01.1
tctcacaaaaacctcatcaatcacaaccatgggttcaacaggtgaaactcaaataccacatatcagatgaagaaccaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3421 - DNA, 365 bp, Artificial
  MsCOMT deletion introduced by TALEN pair MsCOMT_T01.1
tctcacaaaaacctcatcaatcacaaccatgggttcaacaggtgaaactcaaataccacaacccaactatcagatgaagaagcaaacctcttcgccatgccattaacaaagtcttcagttcttcccatgattttaaaatcagctcttgaacttgaactcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3422 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcatatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3423 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcatatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3424 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatagcctcacttgttcagttcgtactcaaccagatggaaaggttcagagactttatggtttggctactgttgctaa

SEQ ID NO: 3425 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagattaagaagcacacctcttcgccatgcaactagcaagtgcttcagttcttcccatgattttgaaatcagctcttgaacttgatctctcagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3426 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgatgaagcaaccctcttcgccatgcaattagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3427 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgacgaagcaaacctcttcgccatgcaattagcaagtgcttcagttcttcccatgattttgaaatcagctcttgaacttgatctcttagaaatcattgctaaagctggacctggtgcttaaatttcacctattgaaattgcttctcagctaccaacaactaaccctgatgctccagttatgttggaccgaatgttgcgtctcttggcttgttacaatatcctcacttgttcagttcgtactcaacaagatggaaaggttcagagactttatggtttggctactgttgctaa

SEQ ID NO: 3428 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcatacctcttcgccatgcaactagcaagtccttcagttcttcccatgattttgaaatcagctcttgaacttgatctcttagaaatcattgctaaagcgggacctggtgctcaaattgcacctattgaaattgcttctcagctaccaacaactaaccctgatgcaccagttatgtgggaccgaatgttgcgtctcttggcttgttacaatatcctcacttgttcagttcgtactcaacaagatggaaaggttcagagactgtatggtttggctactgttgctaa

SEQ ID NO: 3429 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttctccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 3430 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaaagttcagagactttatggtttggctactgttgctaa

SEQ ID NO: 3431 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3432 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3433 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3434 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctactgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3435 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 3436 - DNA, 362 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgtgctaa

SEQ ID NO: 3437 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3438 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3439 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 3440 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3441 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3442 - DNA, 362 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 3443 - DNA, 362 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcattgttcagttcgtactcaacaagatggaaagattcagagactttatggtttggctactgttgctaa

SEQ ID NO: 3444 - DNA, 362 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 3445 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3446 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3447 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3448 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3449 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3450 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 3451 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttcccagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3452 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3453 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3454 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3455 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3456 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgtggctaa

SEQ ID NO: 3457 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3458 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3459 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3460 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3461 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3462 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtttagagactttatggtttggctactgttgctaa

SEQ ID NO: 3463 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3464 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcacacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3465 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaatcctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3466 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3467 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3468 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3469 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3470 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttgtgttggaccgaatgttgcgtctcttggcttgttacaatatcctcacttgttcagttcgtactcaacaagatggaaagattcagagactttatggtttggctactgttgctaa

SEQ ID NO: 3471 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3472 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3473 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 3474 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3475 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3476 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaattttacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3477 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 3478 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3479 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3480 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3481 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3482 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3483 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3484 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacgagatggaaagattcagagactttatggtttggctactgttgctaa

SEQ ID NO: 3485 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3486 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 3487 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcatttcgtactcaacaagatggaaaggttcagagactttatggtttggctactgttgctaa

SEQ ID NO: 3488 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtttagagactttatggtttggctactgttgctaa

SEQ ID NO: 3489 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaaagttgcgtctcttggcttgttacaatatcctcacttgttcagttcgtactcaacaagatggaaagattcagagactttatggtttggctactgttgctaa

SEQ ID NO: 3490 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 3491 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3492 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3493 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 3494 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3495 - DNA, 362 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctatgttgctaa

SEQ ID NO: 3496 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagacggaaagattcagagcctttatggtttggctacttttgctaa

SEQ ID NO: 3497 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3498 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatccgcacttgttcagttcgttctgagcaaggtggaaaggttcagagactttatggtttggctactggtgctaa

SEQ ID NO: 3499 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagagggaaaggttcagagcctttatggtttggctactgttgctaa

SEQ ID NO: 3500 - DNA, 362 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 3501 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 3502 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctactgaaattgcttctcggctcccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 3503 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctaaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3504 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3505 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacacggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3506 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaataattgctaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3507 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattagcaagtgcgtcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaagattcagagactttatggtttggctactgttgctaa

SEQ ID NO: 3508 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggctcgttacaatatcctcacttgttcagttcgtactcaacaagatggaaagattcagaaactttatggtttggctactgttgctaa

SEQ ID NO: 3509 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcggctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3510 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 3511 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcccctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3512 - DNA, 362 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgcaa

SEQ ID NO: 3513 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3514 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3515 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3516 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3517 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3518 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcacctgttatgttggaccgaatgttgcgtctcttggcttgttacaatatcctcacttgttcagttcgtactcagcaagatggaaagattcagagactttatggtttggctactgtggctaa

SEQ ID NO: 3519 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3520 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3521 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgactcttggcttgttacaatatcctcacttgttcagttcgtactcaacaagatggaaaggttcagagactttatggtttggctactgttgctaa

SEQ ID NO: 3522 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 3523 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3524 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3525 - DNA, 362 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 3526 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3527 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3528 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatccactcttgttcagttcgtactcaacaagatggaaaagttcagagactttatggtttggctactgttgctaa

SEQ ID NO: 3529 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3530 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaatatggaaaggttcagagactttatggtttggctactgttgctaa

SEQ ID NO: 3531 - DNA, 364 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtttgctaa

SEQ ID NO: 3532 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 3533 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactggtgctaa

SEQ ID NO: 3534 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaagattcagagactttatggtttggctactgttgctaa

SEQ ID NO: 3535 - DNA, 360 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttct

SEQ ID NO: 3536 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3537 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgtcggaccgaatgttgcgtctcttggcttgttacaatatcctcacttgttcagttcgtactcaacaagatggaaaggttcagagactttatggtttggctactgttgctaa

SEQ ID NO: 3538 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaactaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3539 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaactattgaaattgcttctcagctaccaacaactaaccctgatgcaccagttatgttggaccgaaagttgcgtctctttgcttgttacaatatcctcacttgttcagttcgttctcaacaagatggaaaggttcagagactttatggtttggctactgttgctaa

SEQ ID NO: 3540 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3541 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3542 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3543 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3544 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgtaggaccgaatgttgcgtctcttggcttgttacaatatcctcacttgttctgttcgtactcaacaagatggaaaggttcagagactttatggtttggctactgttgctaa

SEQ ID NO: 3545 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3546 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3547 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 3548 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3549 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtattcaacaagatggaaagattcagagactttatggtttggctactgttgctaa

SEQ ID NO: 3550 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3551 - DNA, 362 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactagcaagtgcttcagttcttcccatgatttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3552 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3553 - DNA, 363 bp, Artificial
  MsCOMT deletion introduced by TALEN pair MsCOMT_T01.1
tctcacaaaaacctcatcaatcacaaccatgggttcaacaggtgaaactcaaataccaacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3554 - DNA, 359 bp, Artificial
  MsCOMT deletion introduced by TALEN pair MsCOMT_T01.1
tctcacaaaaacctcatcaatcacaaccatgggttcaacaggtgaaactcaaataccaacatatcggatgaagaaccaaacctcttcgcaatgaaataacaaagggcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3555 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3556 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagctgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3557 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccgtgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 3558 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3559 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3560 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3561 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3562 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3563 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 3564 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3565 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3566 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3567 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3568 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3569 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcagcaagatggaaagattcagaggctttatggtttggctactgttgctaa

SEQ ID NO: 3570 - DNA, 354 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 3571 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3572 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3573 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3574 - DNA, 354 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 3575 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3576 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3577 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3578 - DNA, 355 bp, Artificial
  MsCOMT deletion introduced by TALEN pair MsCOMT_T01.1
tctcacaaaaacctcatcaatcacaaccatgggttcaacaggtgaaactcaaatacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3579 - DNA, 459 bp, Artificial
  MsCOMT deletion introduced by TALEN pair MsCOMT_T01.1
tctcacaaaaacctcatcaatcacaaccatgggttcaacaggtgaaactcaaatacaccgcgttgctggcgtttttccataggctccgcccccctgacgagcatcacaaaaatcgacgctcaagtcagaggtggcgaaacccgacaggactataacccacatatcagatgacgaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3580 - DNA, 459 bp, Artificial
  MsCOMT deletion introduced by TALEN pair MsCOMT_T01.1
tctcacaaaaacctcatcaatcacaaccatgggttcaacaggtgaaactcaaatacaccgcgttgctggcgtttttccataggctccgcccccctgacgagcatcacaaaaatcgacgctcaagtcagaggtggcgaaacccgacaggactataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3581 - DNA, 459 bp, Artificial
  MsCOMT deletion introduced by TALEN pair MsCOMT_T01.1
tctcacaaaaacctcatcaatcacaaccatgggttcaacaggtgaaactcaaatacaccgcgttgctggcgtttttccataggctccgcccccctgacgagcatcacaaaaatcgacgctcaagtcagaggtggcgaaacccgacaggactataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3582 - DNA, 459 bp, Artificial
  MsCOMT deletion introduced by TALEN pair MsCOMT_T01.1
tctcacaaaaacctcatcaatcacaaccatgggttcaacaggtgaaactcaaatacaccgcgttgctggcgtttttccataggctccgcccccctgacgagcatcacaaaaatcgacgctcaagtcagaggtggcgaaacccgacaggactataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3583 - DNA, 459 bp, Artificial
  MsCOMT deletion introduced by TALEN pair MsCOMT_T01.1
tctcacaaaaacctcatcaatcacaaccatgggttcaacaggtgaaactcaaatacaccgcgttgctggcgtttttccataggctccgcccccctgacgagcatcacaaaaatcgacgctcaagtcagaggtggcgaaacccgacaggactataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3584 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccgacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3585 - DNA, 365 bp, Artificial
  MsCOMT deletion introduced by TALEN pair MsCOMT_T01.1
tctcacaaaaacctcatcaatcacaaccatgggttcaacaggtgaaactcaaatacacccacccccatatccgatgaagaagccaacctcttcgccctgcaactagccaatgcttcagttcttcccatgattttgaaatcagctcttgaacttgatctcttagaaatcattgctaaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagggactttatggtttggctactgttgctaa

SEQ ID NO: 3586 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacctatcagatgaagaagcaaacctcttcgccattcaattaacaaggtcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3587 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatattagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3588 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcggatgaagaagcaaacctcttcgccatgcaactagcaagtgcttcagttcttcccatgattttgaaatcagctcttgaacttgatctcttagaaatcattgctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3589 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaaccttttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3590 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3591 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3592 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcgattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagtttagagactttatggtttggctactgttgctaa

SEQ ID NO: 3593 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3594 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3595 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3596 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3597 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3598 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttccaatatcctcacttgttcagttcgtactcaacaagatggaaagattcagagactttatggtttggctactgttgctaa

SEQ ID NO: 3599 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3600 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3601 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3602 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3603 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3604 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtacgtactcaacaagatggaaagattcagagactttatggtttggctactgttgctaa

SEQ ID NO: 3605 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3606 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3607 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3608 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctattgttgctaa

SEQ ID NO: 3609 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3610 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtgctcaacaagatggaaagattcagagactttatggtttggctactgttgctaa

SEQ ID NO: 3611 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 3612 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgatacaatatcctcacttgttcagttcgtactcaacaagacggaaaggttcagagactttatggtttggctactgttgctaa

SEQ ID NO: 3613 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgatctcttagaaatcattgctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3614 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttaatctcttagaaatcattgctaaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 3615 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3616 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3617 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3618 - DNA, 365 bp, Artificial
  MsCOMT deletion introduced by TALEN pair MsCOMT_T01.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3619 - DNA, 359 bp, Artificial
  MsCOMT deletion introduced by TALEN pair MsCOMT_T01.1
tctcacaaaaacctcatcaatcacaaccatgggttcaacaggtgaaactcaaatacacacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3620 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacgcacatatcagatgaagaagcaaacctcttcgacatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3621 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3622 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3623 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3624 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3625 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3626 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3627 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3628 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3629 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgctgcgtctcttggcttgttacaatatcctcacttgttcagttcgtactcaacaagatggaaaggttcagagactttatggtttggctactgttgctaa

SEQ ID NO: 3630 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3631 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattggcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3632 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3633 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3634 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3635 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3636 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3637 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3638 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3639 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3640 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 3641 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3642 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3643 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3644 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3645 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaattagcaagtgcttcaattcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3646 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaccttttgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3647 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3648 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3649 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3650 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3651 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3652 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3653 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 3654 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcacttggcttgttacaatatcctcacttgttctgttcgtactcaacaagatggaaaggttcagagactttatggtttggctactgttgctaa

SEQ ID NO: 3655 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3656 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3657 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3658 - DNA, 362 bp, Artificial
  MsCOMT deletion introduced by TALEN pair MsCOMT_T01.1
tctcacaaaaacctcatcaatcacaaccatgggttcaacaggtgaaactcaaatacaacccacatatcagatgaagaagcaaacctcttcgccatgaaattagcaagtccttcagttcttcccatgattttgaaatcagctcttgaacttgatctcttagaaatcattgctaaagctggaccttgtgctcaaatttcaccgattgtaattgcttctcagctaccaacaactaaccctgatgcaccagttatgttggaccgaatgtggcgtctctttgctagttacaagttcctcagttgttcagttcgtactcagcaagattgaaagattcagagacattatggtttggctactgatgctaa

SEQ ID NO: 3659 - DNA, 445 bp, Artificial
  MsCOMT deletion introduced by TALEN pair MsCOMT_T01.1
tctcacaaaaacctcatcaatcacaaccatgggttcaacaggtgaaactcaaataatgttggcaagcatgcgctggagacggtccagcggctgttgcctgtgctttgccaggcccacggctttaccccggagcaggtccaacccacatatcagatgaagaagcaaacctcttcgccatgcaactaccaagggcttcagttcttcccatgattttgaaatcagctcttgaacttgatctcttagaaatcattgctaaagctggacctggtgctcaaatttcacctgttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3660 - DNA, 445 bp, Artificial
  MsCOMT deletion introduced by TALEN pair MsCOMT_T01.1
tctcacaaaaacctcatcaatcacaaccatgggttcaacaggtgaaactcaaataatgttggcaagcaggcgctggagacggtccagcggctgttgcctgtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3661 - DNA, 445 bp, Artificial
  MsCOMT deletion introduced by TALEN pair MsCOMT_T01.1
tctcacaaaaacctcatcaatcacaaccatgggttcaacaggtgaaactcaaataatgttggcaagcaggcgctggagacggtccagcggctgttgcctgtgctgtgccaggcccacggcttgaccccggagcaggtccaacccacatatcagatgaagaagcaaacctcttcgccatgcaactagcaagtgcttcagttcttcccatgattttgaaatcagctcttgaacttggtctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3662 - DNA, 445 bp, Artificial
  MsCOMT deletion introduced by TALEN pair MsCOMT_T01.1
tctcacaaaaacctcatcaatcacaaccatgggttcaacaggtgaaactcaaataatgttggcaagcaggcgctggagacggtccagcggctgttgccggtgctgtgccaggcccacggcttgaccccggagcaggtccaacccacatatcagatgaagaagcaaacctcttcgccatgcaattagccagtgcttcagttcttcccatgattttgaaatcagctcttgaacttgatctcttagaaatcattgctaaagctggacctggtgctcaaatttcacctattgaaattgattctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3663 - DNA, 445 bp, Artificial
  MsCOMT deletion introduced by TALEN pair MsCOMT_T01.1
tctcacaaaaacctcatcaatcacaaccatgggttcaacaggtgaaactcaaataatgttggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 3664 - DNA, 445 bp, Artificial
  MsCOMT deletion introduced by TALEN pair MsCOMT_T01.1
tctcacaaaaacctcatcaatcacaaccatgggttcaacaggtgaaactcaaataatgttggcaagcaggcgctggagacggtccagcggctgttgccggtgctgtgccaggcccacggcttgaccccggagcaggtccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3665 - DNA, 445 bp, Artificial
  MsCOMT deletion introduced by TALEN pair MsCOMT_T01.1
tctcacaaaaacctcatcaatcacaaccatgggttcaacaggtgaaactcaaataatgttggcaagcaggcgctggagacggtccagcggctgttgccggtgctgtgccaggcccacggcttgaccccggagcaggtccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3666 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgtcggtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3667 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgcctgtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3668 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3669 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3670 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3671 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3672 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3673 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3674 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcccttggcttgttacaatatcctcacttgttctgttcgtactcaacaagatggaaaggttcagagactttatggtttggctactgttgctaa

SEQ ID NO: 3675 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3676 - DNA, 444 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3677 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtttctaa

SEQ ID NO: 3678 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3679 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3680 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagctagccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3681 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccaggcccacggcttgaccccggagcaggtccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3682 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggtgctgtgccagacccacggcttgaccccggagcaggtccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3683 - DNA, 445 bp, Artificial
  MsCOMT deletion introduced by TALEN pair MsCOMT_T01.1
tctcacaaaaacctcatcaatcacaaccatgggttcaacaggtgaaactcaaataatggtggcaagcaggcgctggagacggtccagcggctgttgccggggctgtgccaggcccacggcttgaccccggagcaggtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3684 - DNA, 359 bp, Artificial
  MsCOMT deletion introduced by TALEN pair MsCOMT_T01.1
tctcacaaaaacctcatcaatcacaaccatgggttcaacaggtgaaactcaaataatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 3685 - DNA, 360 bp, Artificial
  MsCOMT deletion introduced by TALEN pair MsCOMT_T01.1
tctcacaaaaacctcatcaatcacaaccatgggttcaacaggtgaaactcaaataatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3686 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3687 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaatcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3688 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3689 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3690 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3691 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttgaaatccgctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3692 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttgaaatcagctcttgaacttgatctcttagaaatcattgctaaagctgggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3693 - DNA, 353 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctatgttgctaa

SEQ ID NO: 3694 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3695 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3696 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3697 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3698 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3699 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3700 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtctggctactgttgctaa

SEQ ID NO: 3701 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 3702 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3703 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3704 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagttcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3705 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaagattcagagactttattgtttggcgactgttgctaa

SEQ ID NO: 3706 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3707 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtttgtactcaacaagatggaaaagttcagagactttatggtttggctactgttgctaa

SEQ ID NO: 3708 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3709 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3710 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctctaggcttgttacaatatcctcacttgttcagttcgtactcaacaagatggaaagattcagagactttatggtttggctactgttgctaa

SEQ ID NO: 3711 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3712 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3713 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3714 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3715 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgattttaaaatcagctcttgaacttgatctcttagaaatcattgctaaagctggacctggtcctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3716 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagtgcttcagttcttcccatgatttaaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3717 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3718 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaactagcaattgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3719 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3720 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3721 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3722 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3723 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaactagcaagtgcttcagttcttcccatgattttgaaatcagctcttgaacttgatctcttagaaatcattgctaaagctggacctggtgctcaaatttcacatgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3724 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3725 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3726 - DNA, 354 bp, Artificial
  MsCOMT deletion introduced by TALEN pair MsCOMT_T01.1
tctcacaaaaacctcatcaatcacaaccatgggttcaacaggtgaaactcaaataatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3727 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3728 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3729 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3730 - DNA, 361 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaccctcttcgccatgcaattagcaagtgcttcagttcttcccatgatttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3731 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3732 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaccctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3733 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3734 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3735 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3736 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3737 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3738 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttaaaatcagctcttgaacttgatctcttagaaatcattgctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3739 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3740 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3741 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3742 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 3743 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3744 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3745 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3746 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3747 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactactaaccctgatgcaccagttatgttggaccgaatgctgcgtctcttggcttgttacaatatcctcacttgttcagttcgtactcaacaagatggaaaagttcagagactttatggtttggctactgttgctaa

SEQ ID NO: 3748 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3749 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3750 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3751 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3752 - DNA, 362 bp, Artificial
  MsCOMT deletion introduced by TALEN pair MsCOMT_T01.1
tctcacaaaaacctcatcaatcacaaccatgggttcaacaggtgaaactcaaataatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3753 - DNA, 361 bp, Artificial
  MsCOMT deletion introduced by TALEN pair MsCOMT_T01.1
tctcacaaaaacctcatcaatcacaaccatgggttcaacaggtgaaactcaaataagcccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3754 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaatgtagtctgcaaataaccctcgagccacccctgaccaaaatcccttaacgtgagttacgcgtccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3755 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtctgcaaataaccctcgagccacccatgaccaaaatcccttaacgtgagttacgcgtccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3756 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtctgcaaataaccctcgagccacccatgaccaaaatcccttaacgtaagttacgcgtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3757 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcggcaaataaccctcgagccacccctgaccaaaatcccttaacgtgagttacgcgtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3758 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcggcaaataaccctcgagccacccctgaccaaaatcccttaacgtgagttacgcgtccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3759 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcggcaaataaccctcgagccacccatgaccaaaatcccttaacgtgagttacgcgtccaacccacatatcagatgcagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3760 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcggcaaataaccctcgagccacccatgaccaaaatcccttaacgtgagttacgcgtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3761 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcggcaaataaccctcgagccacccatgaccaaaatcccttaacgtgagttacgcgtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3762 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcggcaaataaccctcgagccacccatgaccaaaatcccttaacgtgagttacgcgtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacatattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3763 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcggcaaataaccctcgagccacccatgaccaaaatcccttaacgtgagttacgcgtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3764 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcggcaaataaccctcgagccacccatgaccaaaatcccttaacgtgagttacgcgtccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3765 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcggcaaataaccctcgagccacccatgaccaaaatcccttaacgtgagttacgcgtccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3766 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcggcaaataaccctcgagccacccatgaccaaaatcccttaacgtgagttacgcgaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3767 - DNA, 461 bp, Artificial
  MsCOMT deletion introduced by TALEN pair MsCOMT_T01.1
tctcacaaaaacctcatcaatcacaaccatgggttcaacaggtgaaactcaaataagaatttgtccactacgtgaaaggcgagatcaccaaggtagtcagcaaataaccctcgagccacccatgaccaaaatcccttaacgtgagttacgcgtccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3768 - DNA, 364 bp, Artificial
  MsCOMT deletion introduced by TALEN pair MsCOMT_T01.1
tctcacaaaaacctcatcaatcacaaccatgggttcaacaggtgaaactcaaataactccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3769 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagattaagaagcaaacctcttcgccatgcaactagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3770 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgccactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3771 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgccactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgtttgaccgaatgttgcgtctcttggcttgttacaatatcctcacttgttcagttcgtactcaacaagatggaaaggttcagagactttatggtttggctactgttgctaa

SEQ ID NO: 3772 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3773 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3774 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaattgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3775 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactgtatggtttggctactgttgctaa

SEQ ID NO: 3776 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3777 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcatcagttatgttggaccgaatgttgcgtctcttggcttgttacaatatcctcacttgttcagttcgtactcaacaagatggaaagattcagagactttatggtttggctactgttgctaa

SEQ ID NO: 3778 - DNA, 352 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 3779 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3780 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3781 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttattttggaccgaatgttgcgtctcttggcttgttacaatatcctcacttgttcagttcgtactcaacaagatggaaaggttcagagactttatggtttggctactgttgctaa

SEQ ID NO: 3782 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3783 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3784 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 3785 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgccaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3786 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3787 - DNA, 353 bp, Artificial
  MsCOMT deletion introduced by TALEN pair MsCOMT_T01.1
tctcacaaaaacctcatcaatcacaaccatgggttcaacaggtgaaactcaaataactcagatgaagaaacaaacctcttcgccatgcaactagcaagtgcatcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3788 - DNA, 360 bp, Artificial
  MsCOMT deletion introduced by TALEN pair MsCOMT_T01.1
tctcacaaaaacctcatcaatcacaaccatgggttcaacaggtgaaactcaaataactcacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3789 - DNA, 360 bp, Artificial
  MsCOMT deletion introduced by TALEN pair MsCOMT_T01.1
tctcacaaaaacctcatcaatcacaaccatgggttcaacaggtgaaactcaaataactcacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3790 - DNA, 360 bp, Artificial
  MsCOMT deletion introduced by TALEN pair MsCOMT_T01.1
tctcacaaaaacctcatcaatcacaaccatgggttcaacaggtgaaactcaaataactcacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3791 - DNA, 360 bp, Artificial
  MsCOMT deletion introduced by TALEN pair MsCOMT_T01.1
tctcacaaaaacctcatcaatcacaaccatgggttcaacaggtgaaactcaaataactcacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3792 - DNA, 360 bp, Artificial
  MsCOMT deletion introduced by TALEN pair MsCOMT_T01.1
tctcacaaaaacctcatcaatcacaaccatgggttcaacaggtgaaactcaaataactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3793 - DNA, 360 bp, Artificial
  MsCOMT deletion introduced by TALEN pair MsCOMT_T01.1
tctcacaaaaacctcatcaatcacaaccatgggttcaacaggtgaaactcaaataactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3794 - DNA, 360 bp, Artificial
  MsCOMT deletion introduced by TALEN pair MsCOMT_T01.1
tctcacaaaaacctcatcaatcacaaccatgggttcaacaggtgaaactcaaataactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3795 - DNA, 360 bp, Artificial
  MsCOMT deletion introduced by TALEN pair MsCOMT_T01.1
tctcacaaaaacctcatcaatcacaaccatgggttcaacaggtgaaactcaaataactcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3796 - DNA, 355 bp, Artificial
  MsCOMT deletion introduced by TALEN pair MsCOMT_T01.1
tctcacaaaaacctcatcaatcacaaccatgggttcaacaggtgaaactcaaataactatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3797 - DNA, 355 bp, Artificial
  MsCOMT deletion introduced by TALEN pair MsCOMT_T01.1
tctcacaaaaacctcatcaatcacaaccatgggttcaacaggtgaaactcaaataactatcagatgaagaagcaaacctcttcgccatgcaattagcaagtgcttcagttcttcccatgattttaaaatcagctcttgaacttgatctcttagaaatcatggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3798 - DNA, 355 bp, Artificial
  MsCOMT deletion introduced by TALEN pair MsCOMT_T01.1
tctcacaaaaacctcatcaatcacaaccatgggttcaacaggtgaaactcaaataactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3799 - DNA, 355 bp, Artificial
  MsCOMT deletion introduced by TALEN pair MsCOMT_T01.1
tctcacaaaaacctcatcaatcacaaccatgggttcaacaggtgaaactcaaataactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3800 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3801 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcatatgaagaagcaaacctcttctccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3802 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3803 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatattggaccgaatgttgcatctcttggcttgttacaatatcctcacttgttcagttcgtactcaacaagatggaaagattcagagactttatggtttggctactgttgctaa

SEQ ID NO: 3804 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3805 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3806 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcacacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3807 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3808 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3809 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3810 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctaatgttgctaa

SEQ ID NO: 3811 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3812 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3813 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3814 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3815 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3816 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3817 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3818 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatccccacttgttctgttcgtactcaacaagatggaaaggttcagagactttatggtttggctactgttgctaa

SEQ ID NO: 3819 - DNA, 363 bp, Artificial
  MsCOMT deletion introduced by TALEN pair MsCOMT_T01.1
tctcacaaaaacctcatcaatcacaaccatgggttcaacaggtgaaactcaaataactacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3820 - DNA, 475 bp, Artificial
  MsCOMT deletion introduced by TALEN pair MsCOMT_T01.1
tctcacaaaaacctcatcaatcacaaccatgggttcaacaggtgaaactcaaataacgcaattaatacgcgtaccgctagccaggaagagtttgtagaaacgcaaaaaggccatccgtcaggatggccttctgcttagtttgatgcctggcagtttatggcgggcgtgcacaccacatattagatgaagaagcaaaacccctcgccctgcaaatagcaacagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3821 - DNA, 411 bp, Artificial
  MsCOMT deletion introduced by TALEN pair MsCOMT_T01.1
tctcacaaaaacctcatcaatcacaaccatgggttcaacaggtgaaactcaaataaccttaaaaaggccgcgttgctggcgtttttccataggctccgccaccccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3822 - DNA, 420 bp, Artificial
  MsCOMT deletion introduced by TALEN pair MsCOMT_T01.1
tctcacaaaaacctcatcaatcacaaccatgggttcaacaggtgaaactcaaataacctgggtcaagccgtgggcctggcacagcaccggcaacagccgctggaccgtctccagcgcctgcttatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3823 - DNA, 360 bp, Artificial
  MsCOMT deletion introduced by TALEN pair MsCOMT_T01.1
tctcacaaaaacctcatcaatcacaaccatgggttcaacaggtgaaactcaaataacctacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3824 - DNA, 360 bp, Artificial
  MsCOMT deletion introduced by TALEN pair MsCOMT_T01.1
tctcacaaaaacctcatcaatcacaaccatgggttcaacaggtgaaactcaaataacctacatatcagaggaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaatttcagagactttatggtttggctactgttgctaa

SEQ ID NO: 3825 - DNA, 411 bp, Artificial
  MsCOMT deletion introduced by TALEN pair MsCOMT_T01.1
tctcacaaaaacctcatcaatcacaaccatgggttcaacaggtgaaactcaaataaccgtaaaaaggccgcgttgctggcgtttttccataggctcctccaccccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3826 - DNA, 411 bp, Artificial
  MsCOMT deletion introduced by TALEN pair MsCOMT_T01.1
tctcacaaaaacctcatcaatcacaaccatgggttcaacaggtgaaactcaaataaccgtaaaaaggccgcgttgctggcgtttttccataggctccgccaccccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaatattcagagactttatggtttggctactgttgctaa

SEQ ID NO: 3827 - DNA, 411 bp, Artificial
  MsCOMT deletion introduced by TALEN pair MsCOMT_T01.1
tctcacaaaaacctcatcaatcacaaccatgggttcaacaggtgaaactcaaataaccgtaaaaaggccgcgttgctggcgtttttccataggctccgccaccccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3828 - DNA, 411 bp, Artificial
  MsCOMT deletion introduced by TALEN pair MsCOMT_T01.1
tctcacaaaaacctcatcaatcacaaccatgggttcaacaggtgaaactcaaataaccgtaaaaaggccgcgttgctggcgtttttccataggctccgccaccccaacccacatatcagatgaagaagcaaacctcttcgccatgcaactagcatgtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3829 - DNA, 411 bp, Artificial
  MsCOMT deletion introduced by TALEN pair MsCOMT_T01.1
tctcacaaaaacctcatcaatcacaaccatgggttcaacaggtgaaactcaaataaccgtaaaaaggccgcgttgctggcgtttttccataggctccgccaccccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3830 - DNA, 411 bp, Artificial
  MsCOMT deletion introduced by TALEN pair MsCOMT_T01.1
tctcacaaaaacctcatcaatcacaaccatgggttcaacaggtgaaactcaaataaccgtaaaaaggccgcgttgctggcgtttttccataggctccgccaccccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3831 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcaccgcaccggcaacagccgctggaccgtctccagcgcctgcttatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3832 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcaccgcaccggcaacagccgctggaccgtctccagcgcctgcttatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3833 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgcctgcttatcggatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3834 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgcctgcttatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3835 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgcctgcttatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3836 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgcctgcttatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3837 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgcctgcttatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3838 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgcctgcttatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 3839 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgcctgcttatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3840 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgcctgcttatcagatgaagaagcaaacctcttcgccatgcaattagcaagtgcttcagttcttcccatgattttaaaatcagctcttgaacttgatctcttagaaatcactgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3841 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgcctgcttatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3842 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgcctgcttatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3843 - DNA, 420 bp, Artificial
  MsCOMT deletion introduced by TALEN pair MsCOMT_T01.1
tctcacaaaaacctcatcaatcacaaccatgggttcaacaggtgaaactcaaataaccggggtcaagccgtgggcctggcacagcaccggcaacagccgctggaccgtctccagcgccggcttatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3844 - DNA, 364 bp, Artificial
  MsCOMT deletion introduced by TALEN pair MsCOMT_T01.1
tctcacaaaaacctcatcaatcacaaccatgggttcaacaggtgaaactcaaataaccgacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3845 - DNA, 360 bp, Artificial
  MsCOMT deletion introduced by TALEN pair MsCOMT_T01.1
tctcacaaaaacctcatcaatcacaaccatgggttcaacaggtgaaactcaaataacccccatctccgatgcagatgcaaacctcttcgccatgcaactagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3846 - DNA, 360 bp, Artificial
  MsCOMT deletion introduced by TALEN pair MsCOMT_T01.1
tctcacaaaaacctcatcaatcacaaccatgggttcaacaggtgaaactcaaataacccccatctacgatgaagaagcaaacctcatcgccatgcccttagcacgagcttcagctcttccccttattttaaaatcagctcttgcacttgatctcgtagaaatcatagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3847 - DNA, 360 bp, Artificial
  MsCOMT deletion introduced by TALEN pair MsCOMT_T01.1
tctcacaaaaacctcatcaatcacaaccatgggttcaacaggtgaaactcaaataacccccatatcagatgaagaagcaaacatattcgtcatgcacttagcacgagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3848 - DNA, 360 bp, Artificial
  MsCOMT deletion introduced by TALEN pair MsCOMT_T01.1
tctcacaaaaacctcatcaatcacaaccatgggttcaacaggtgaaactcaaataacccccatatacaattaagatgcaaacctcttccccttccacttagcaatagcttcagctcttcccatgattttaaaatcagcacttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3849 - DNA, 360 bp, Artificial
  MsCOMT deletion introduced by TALEN pair MsCOMT_T01.1
tctcacaaaaacctcatcaatcacaaccatgggttcaacaggtgaaactcaaataacccccatacccgatgaagatgcaaacctcttcgccatgcaactaccaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3850 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3851 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3852 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccctgcaattagcaagtgcttcagttcttcccatgattttaaaatcagctcttgaactcgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3853 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3854 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3855 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 3856 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3857 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3858 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagttggacctggtgctcaaatttcacctattgaaattgcttctcagcacccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3859 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 3860 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttacggtttggctactgttgctaa

SEQ ID NO: 3861 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3862 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3863 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 3864 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3865 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3866 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3867 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaaggttcagagactttatggtttggctactgttgctaa

SEQ ID NO: 3868 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3869 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttaaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3870 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3871 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3872 - DNA, 390 bp, Artificial
  MsCOMT deletion introduced by TALEN pair MsCOMT_T01.1
tctcacaaaaacctcatcaatcacaaccatgggttcaacaggtgaaactcaaataacccccaacaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3873 - DNA, 361 bp, Artificial
  MsCOMT deletion introduced by TALEN pair MsCOMT_T01.1
tctcacaaaaacctcatcaatcacaaccatgggttcaacaggtgaaactcaaataaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3874 - DNA, 360 bp, Artificial
  MsCOMT deletion introduced by TALEN pair MsCOMT_T01.1
tctcacaaaaacctcatcaatcacaaccatgggttcaacaggtgaaactcaaataacccatatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3875 - DNA, 360 bp, Artificial
  MsCOMT deletion introduced by TALEN pair MsCOMT_T01.1
tctcacaaaaacctcatcaatcacaaccatgggttcaacaggtgaaactcaaataacccagatatcagatgaagaagcaaacctcttcgccatggaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3876 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacttatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3877 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatgtcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3878 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3879 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3880 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcatatgaagaagcaaacctcttcgccatgcaactagcaagtgcttcagttcttcccatgattttgaaatcagctcttgaacttgatctcttagagatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3881 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3882 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcagattaagaagcaaacctcttccccatgcaactagaacgagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3883 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3884 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcagatgaagaagcaaacctcttcgccatgcaattagcaagtgcttcagttcttcccatgattttaaaatcagctcttgaacttgatctattagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3885 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3886 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 3887 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3888 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3889 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3890 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctaagatgcagaagaaaacctcttcgccatgcaattagaaagtgcttcagttcttcccctgattttaaaatcagctcttgaacttaatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3891 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctaagatgaagaagcaaacctcttcgccatgcaactagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3892 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatctaaaatgaagaagaaaacctcttcgccatgcaaatagcaagtgcttcagttcttcccctgattttgaaatcaactcttgcacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3893 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatccccgttgaagatgcaaacctcttcgccatgcacttaccacttgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3894 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatccccaattcagatgcaaacctcatcctcatgccactaccaagagcatcagttcttcccatgattttgaaatcagctcttgaacttgatctcttagaaatcattgctaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3895 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatattagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3896 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatctgatgaagaagcaaacctcttcgccatgcaattagcaagtgcttcagttcttcccatgattttaaaatcagctcttgaacttgatctcttagaaatcattgctaaacctggacctggtgctcacatttcgcctattgaaattgcttcacagctcccaacagctaaccctgatgcaccagttatgttggaccgaatgttgcatctcttggcttgttacaatatcctcacttgttcagttcgtactcaacaagatggaaagattcagagactttatggtttggcgactgttgctaa

SEQ ID NO: 3897 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcggatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3898 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 3899 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3900 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3901 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3902 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3903 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3904 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatccgatgaagaagcaaacctcttcgccatgcacttagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3905 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatccgatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3906 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatccgatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3907 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3908 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3909 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaattgcttcagttcttcccatgattttaaaatcagctcttgaacttgatctcttagaaatcattgctaaagctggacctggtgctcaaatttcacctgttcaaattgcttcgcagcttccaacaactaaccctgatgcaccagtcatgttggaccgaatgttgcgtctcttggcttgtttcaatatcctcacttgttctgttcgtactcaacaagatggaaaggttcagagactttatggtttggctactgttgctaa

SEQ ID NO: 3910 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccctgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3911 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccctgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3912 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3913 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3914 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3915 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3916 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3917 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3918 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttataaatcattgctaaagctggaccttgtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 3919 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagcaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3920 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3921 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3922 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3923 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3924 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3925 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgctggaccgaatgttgcgtctcttggcttgttacaatatcctcacttgttctgttcgtactcaacaagatggaaaggtacagagactttatggtttggctactgttgctaa

SEQ ID NO: 3926 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3927 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3928 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3929 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3930 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3931 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctccccacaactaaccctgatgcaccagttatgttggaccgaatgttgagtctcttggcttgttacaatatcctctcttgttcagttcgtactcaacaagatggaaaggttcacagactttatggtttggctactgttgctaa

SEQ ID NO: 3932 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3933 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3934 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3935 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3936 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaagattcagagactttatggtttggctactgttgctaa

SEQ ID NO: 3937 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3938 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 3939 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcacagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3940 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3941 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggactgaatgttgagtctcttggcttgttacaatatcctcacttgttcagttcgtactcaacaagatggaaaggttcagagactttatggtttggctactgttgctaa

SEQ ID NO: 3942 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3943 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3944 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 3945 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagtgcttcagttcttcccatcattttgaaatcagctcttgaacttgatctcttagaaatcattgctaaagctggacctggtgctcaaattttacctattgagattgcttctcagctaccaacaactaaccctgatgcaccagttatgttggaccgaatgttgcgtctcttggcttgtttcaaaatcctaacttgttcagttcgtactcaacaagatgtataggttcagagactttatggtttggatacttttgctaa

SEQ ID NO: 3946 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatgcaactagcaagcgcttcagttcttcccatgattttgaaatcagctcttgaacttggtctcttagcactcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 3947 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcatatgaagaagcaaacctcttcgccatccaattagcaagtgcttcagttcttcccatgattttaaaatcagctcttgaacttgatctcttagaaatcattgctaaagctggacctggtgctcaaatttctcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3948 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagttgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3949 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagctgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3950 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcaagtcgtactcaagaagatggaaaagttcagagactttatggtttgcctactgagggtaa

SEQ ID NO: 3951 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcactagcttcagttcttcccatgattttaaaatcagctcttgcacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3952 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgagtctcttggcttgttacaatatcctcacttgttcagttcgtactcaacaagatggaaagattcagagactttatggtttggctactgttgctaa

SEQ ID NO: 3953 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctagttacaatatcctcacttgttcagttcgtactcaacaagatggaaagattcagagactttatggtttggctactgttgctaa

SEQ ID NO: 3954 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3955 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3956 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3957 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3958 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3959 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3960 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3961 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 3962 - DNA, 357 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagagggaaagattcagagactttatggtttggctattgctaa

SEQ ID NO: 3963 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 3964 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3965 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3966 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3967 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 3968 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacatattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3969 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaattagcaagtgcttcagttcatcccattattttaaaatcagctcttgaacttgatctcttagaaatcattgctaaagctggacctagtgctcaaatttcacctattgaaattgcttctcagctaccaacaacaatccctgatgcaccagttatgttggaccgaatattgcgtctcttggcttgttacaatatcctctcttgttcagttcgtactcaacaagatttaaaggttcagagtctttatggtttggctactgttgctaa

SEQ ID NO: 3970 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactatcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 3971 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3972 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3973 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3974 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3975 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3976 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3977 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccggatgttgcgtctcttggcttgttacaatatcctcacttgttcagttcgtactcaacaagatggaaagattcagagactttatggtttggctactgttgctaa

SEQ ID NO: 3978 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3979 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 3980 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3981 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaactaccaacaactaaccctgatgcaccagttatgttggaccgaatgttgcgtctcttggcttgttacaatatcctcacttgttcagttcgtactcaaccagatgtaaaggttcagagactttatggtttggctactgttgctaa

SEQ ID NO: 3982 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3983 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3984 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3985 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3986 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3987 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagattaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3988 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgcagaagcaaacctcttcgccatgcaactagcaagtgcttcagctcttcccatgattttgaaatcagctcttgaacttgatctcttagaaatcattgctaaagctgaacctggtgctcaaatttcacctattgaaattgcttctcagctaccaacaactacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3989 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgcagaagaaaacctcttcgccatgcaactagcatgagcatcagttcttcccatgcctttaaaatcaactcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactatatggtttggctactgttgctaa

SEQ ID NO: 3990 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgatgaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3991 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaggaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3992 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgacgaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3993 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaaggagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 3994 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagatgcaaacctcttcgccttgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3995 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3996 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagtaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 3997 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagctaacctcttcgccatgcaactagcaagtgctttagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 3998 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcgaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttgacttgttacaatatcctcacttgttcagttcgtactcaacaagatggaaaggttcagagactttatggtttggctactgttgctaa

SEQ ID NO: 3999 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcgaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4000 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcgaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4001 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcatacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4002 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcagaactcttcgtcatgcaactagcaagagcatcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4003 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaagcctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4004 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaacctcttcgccatgcaattagcaagtgcttcagttcttcccatgattttaaaatcagctctttaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4005 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaacctcttcgccaagcaaccaagcaattcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4006 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaatctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4007 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacttcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4008 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4009 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4010 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgtcatgcaattagcaagtgcttcagttcttcccctgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4011 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4012 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4013 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgtcatgcaactagcaagtgcttcagttcttcccatgattttgaaatcagctcttgaacttgatctcttagcaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4014 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgctatgcaactagcaagtgcttcagttcttcccatgattttgaaatcagctcttgaacttgatctcttagaaatcattgctaaagctggacctggtgctcaaatttcgcctattgaaattgcttctcagctaccaacaactaaccctgatgcaccagttatgttggaccgaatgttgcgactcttggcttgttacaatatcctcacttgttcagttcgtactcaacaagatggaaaggttcagagactttatggtttggctactgttgctaa

SEQ ID NO: 4015 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgctatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4016 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgctatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4017 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgctatgcaactagcaagtgcttcagttcttcccatgatattgtaatcagctcttgaatttgatctcttagaaatcattgctaaagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 4018 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgcgatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaagattcagagcctttatggtttggctactgttgctaa

SEQ ID NO: 4019 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccgtgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4020 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccattcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4021 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4022 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4023 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgtaattagcaagtgcttcagttcttcccatgattttaaaatcagctcttgaactcgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4024 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4025 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4026 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcgactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4027 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcagttagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4028 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcagttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4029 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcagttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4030 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcagttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaaggtggaaaggttcagagactttatggtttggctactgttgctaa

SEQ ID NO: 4031 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcagttagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4032 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcagctagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4033 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcacttaccaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4034 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattggcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4035 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattggcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4036 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattatcaagtgcttcagttcttcccatgattttaaaatcagctcttgaacttgatctcttagcaatcattgctaaagctggacctgatgctcaaatttcacctattgaaattgcttctcagctcccaacaactaaccctgaggaaccagttatgttggacagaatgttgcgtctcttggattgttacaatatactcaatggttcagttcgtactcaacaagatggaaagattcagagactttatggtttggctactgttgctaa

SEQ ID NO: 4037 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4038 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4039 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4040 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattacttctcagctcccaacatctaaccctgatgcatcagttatattggaccgaatgttgcgtctcttggcttgttacaatatcctcacttgttcagttcgtactcaacaagatggaaaggttcagagactttatggtttggctactgtagctaa

SEQ ID NO: 4041 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattatcaagtgcttcagttcttcccatgattttaaaatcagctcttgaacttgatctcttagaaaccattgctaaagctggacctggtgctcaaatttcacctattgaaattgcttctcagctaccaacaactaaccctgatgcaccagttatgttggaccgaatgttgcgtctattggcttgttacaatatcctcacttgttcagttcgtactcaacaagatggaaaggttcagagactttatggtttggctactgttgctaa

SEQ ID NO: 4042 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 4043 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcgagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4044 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4045 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgtttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4046 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttccgttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4047 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcctatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4048 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4049 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4050 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttaggaatcattgctaaagctgtacctgttgctcaaatttcacctattgaaattgcttctcagctcccaagagctaaccctgatgcaccagttatgttgtaccgaatgttgcatctcttggcttgttacaatatcctcacttgttcagttcgtactcaacaagatggaaagattcagagaatttatggtttggtgactgttgctaa

SEQ ID NO: 4051 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctgctcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4052 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4053 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4054 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaagattcagagcctttatggtttggctactgttgctaa

SEQ ID NO: 4055 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4056 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4057 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4058 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4059 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4060 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 4061 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4062 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccattattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagacattatggtttggctactgttgctaa

SEQ ID NO: 4063 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgttctcttagaaatcattgctaaacctggacctggtgctcaaatttcacctattgaaattgcttctcagctaccaacaactaaccctgatgcaccagttatgttggaccgaatgtggcggctcttggcttgttacaatatcctcacttgtgcagttcgtacgcaacaagatggaaaggttcagagacgttatggtttggctactgttgctaa

SEQ ID NO: 4064 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacttggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4065 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcatctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4066 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4067 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4068 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgtttgaccgaatgttgcgtctcttggcttgttacaatatcccacttgttcagttcgtactcaacaagatggaaaggttcagagactttatggtttggctactgttgctaa

SEQ ID NO: 4069 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4070 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4071 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4072 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4073 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4074 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4075 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattggaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4076 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcatctaccaacaactaacccttatgcaccagttatgttgtaccgaatttttcgtctcttttcttgttacaatatcctcgcttgttcagttcttactcaacaagatggaaaggttcagagactttatggttttgctactgtttctaa

SEQ ID NO: 4077 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4078 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4079 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4080 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 4081 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4082 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4083 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4084 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgagtctcttggcttgttacaatatcctcacttgttcagttcgtactcaacaagatagaaagattcagagactttatggtttggctactgttgctaa

SEQ ID NO: 4085 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4086 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaagattcagagactttatggtttggctactgttgctaa

SEQ ID NO: 4087 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 4088 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4089 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 4090 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 4091 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgttaa

SEQ ID NO: 4092 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacattatcctcacttgttcagttcgtactcaacaagatggaaaggttcagagactttatggtttggctactgttgctaa

SEQ ID NO: 4093 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4094 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4095 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4096 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactctatggtttggctactgttgctaa

SEQ ID NO: 4097 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4098 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4099 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 4100 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaaagttcagagactttatggtttggctactgttgctaa

SEQ ID NO: 4101 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 4102 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtacccaacaagatggaaaggttcagagactttatggtttggctactgttgctaa

SEQ ID NO: 4103 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtctggctactgttgctaa

SEQ ID NO: 4104 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaaagttcagagactttatggtttggctactgttgctaa

SEQ ID NO: 4105 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 4106 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagctcgtactcaacaagatggaaaagttcagagactttatggtttggctactgttgctaa

SEQ ID NO: 4107 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4108 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaatatggaaagattcagagactttatggtttggctactgttgctaa

SEQ ID NO: 4109 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaaagttcagagactttatggtttggctactgttgctaa

SEQ ID NO: 4110 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtggcgtctcttggctggttacaatatcctcacttgttcagttcgtactcaacaagatggaaaggttcagagactttatggtttggctactgttgctaa

SEQ ID NO: 4111 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttacgtctcttggcttgttacaatatcctcacttgttcagttcgtactcaacaagatggaaagattcagagactttatggtttggctactgttgctaa

SEQ ID NO: 4112 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggagagattcagagactttatggtttggctactgttgctaa

SEQ ID NO: 4113 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgaccgaatgttgcgtctcttggcttgttacaatatcctcacttgttcagtgcgtactcaacaagatggaaaggttcagagactttatggtttggctactgttgctaa

SEQ ID NO: 4114 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4115 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgagtctcttggcttgttacaatatcctcacttgttctgttcgtactcaacaagatggaaaggttcagagactttatggtttggctactgttgctaa

SEQ ID NO: 4116 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtatgttggaccgaatgttgcgtctcttggcttgttacaatatcctcacttgttcagttcgtactcaacaagatggaaaggttcagagactttatggtttggctactgttgctaa

SEQ ID NO: 4117 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttatcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4118 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4119 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacccattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4120 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4121 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtcctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4122 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacatggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4123 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagccggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4124 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcctagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4125 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatatcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4126 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcgtgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4127 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttcaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4128 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaagatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4129 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcggctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4130 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcggctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4131 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4132 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgtacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 4133 - DNA, 361 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgttcccttagaaataattgctaaagctggacctggtgctcaaatttcacctgttcaaattgcttctcagcttccaacaactaaccctgatgcaccagtcatgttggaccgaatgttgcgtctcttggcttgttacaatatcctcacttgttcggttcgtactcaacaagatggaaaggttcagagactttatggtttggctactgttgctaac

SEQ ID NO: 4134 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatttcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4135 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagcaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4136 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagcaatcattgctaaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 4137 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagcaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4138 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagcaatcattgctaaagctgcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4139 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaattattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4140 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4141 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 4142 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctacagctgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4143 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaggctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4144 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaacgctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4145 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4146 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4147 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaacgctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 4148 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagtgcagagactttatggtttggctactgtggcgaa

SEQ ID NO: 4149 - DNA, 358 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaacgctggacctggtactcaaatttcacctattgaaattgcttctcagctcccaacaactaaccctgatgcaccagttatgttggaccgaatgttgcgtctcttggcttgatacaatatcctcacttgttcagttcgtactcaacaagatggaaagatgcagagactttatggtttggactgttgctaa

SEQ ID NO: 4150 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4151 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctcccaacaactaaccctgatgcaccagttatgttggaccgaatgttgcgtctcttggcgtgggacaagatcctcactggggaagggcggactcaacaagatggaaaggttcagagactttatggtttggctactgttgctaa

SEQ ID NO: 4152 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctgctgttgctaa

SEQ ID NO: 4153 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4154 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggatctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4155 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4156 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaattttcacctattgaaattgcttctcagctcccaacaactaaccctgatgcaccagttatgttggaccgaatgttgcgtctcttggcttgttacaatatcctcacttgttcagttcgtacgcaacaagatggaaaggttcagagcctttatggtttggctactgttgctaa

SEQ ID NO: 4157 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaactttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 4158 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctcccaacaactaaccctgatgcaccagttatgttggaccgaatgttgcgtctcttggcttgttacaatatcctcacttgttcagttcgtactcagcaagatggaaaagttcagagactttatggtttggctactgttgctaa

SEQ ID NO: 4159 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4160 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4161 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgtttaaattgcttctcagctcccaacaactaaccctgatgcaccagttatgttggaccgaatgttgcgtctcttggcttgttacaatatcctcacttgttcagttcgtactcaacaagatggaaacgttcagagactttatggtttggctactgttgctaa

SEQ ID NO: 4162 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctctgctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4163 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacacctaaccctgatgcaccagtcatgttggaccgaatgttgcgactcttggcttgttacaatatccgcacttgttctgttcgtactcagcaagatggaaaggttcagagactttagggtttggctactgttgctaa

SEQ ID NO: 4164 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaactctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 4165 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4166 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4167 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4168 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4169 - DNA, 361 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaaa

SEQ ID NO: 4170 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcggttcgtactcaacaagatggaaaggttcagagactttatggtttggctactgttgctaa

SEQ ID NO: 4171 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatattgcgtctcttggcttgttacaatatcctcacttgttcagttcgtactcaacaagatggaaagattcagagactttatggtttggctactgttgctaa

SEQ ID NO: 4172 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4173 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4174 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4175 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 4176 - DNA, 356 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttg

SEQ ID NO: 4177 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 4178 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 4179 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcagcaagatggaaaagttcagagactttatggtttggctactgttgctaa

SEQ ID NO: 4180 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcttcacttgttctgttcgtactcaacaagatggaaaggttcagagactttatggtttggctactgttgctaa

SEQ ID NO: 4181 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagacggaaagattcagagactttatggtttggctactgttgctaa

SEQ ID NO: 4182 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgcta

SEQ ID NO: 4183 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttagcttgttacaatatcctcacttgttctgttcgtactcaacaagatggaaaggttcagagactttatggtttgctactgttgctaa

SEQ ID NO: 4184 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggtttgttacaatatcctcacttgttctgttcgtactcaacaagatggaaaggttcagagactttatggtttggctactgttgctaa

SEQ ID NO: 4185 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggattgttacaatatcctcacttgttctgttcgtactcaacaagatggaaaggttcagagactttatggtttggctactgttgctaa

SEQ ID NO: 4186 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcatactcaacaagatggaaaggttcagagactttatggtttggctactgttgctaa

SEQ ID NO: 4187 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgtgctaa

SEQ ID NO: 4188 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatgggttggctactgttgctaa

SEQ ID NO: 4189 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggttactgttgctaa

SEQ ID NO: 4190 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgcta

SEQ ID NO: 4191 - DNA, 361 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaaa

SEQ ID NO: 4192 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttgcaccgaatgttgcgtctcttggcttgttacaatatcctcacttgttcagttcgtactcaacaagatggaaaggttcagagactttatggtttggctactgttgctaa

SEQ ID NO: 4193 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4194 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4195 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4196 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacctgttcagttcgtactcaacaagatggaaagattcagagactttatggtttggctactgttgctaa

SEQ ID NO: 4197 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4198 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttttaccgaatttttcgtctcttggcttgttacaatatcctcacttgttcagttcttactcaacaagatggaaaggttcagagactttatggtttggctactgttgctaa

SEQ ID NO: 4199 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4200 - DNA, 361 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtttgctaa

SEQ ID NO: 4201 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4202 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4203 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 4204 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 4205 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4206 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgatattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4207 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgatattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4208 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatttcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4209 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4210 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4211 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4212 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4213 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattggttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4214 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagttcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4215 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4216 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4217 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4218 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4219 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4220 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 4221 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4222 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4223 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaataactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4224 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4225 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagctaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4226 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4227 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacccttatgcaccagttatgttggaccgaatgttgcgtctcttgtcttgttacaatatcctcacttgttcatttcttactcaacaagattgaaattttcagagactttatggtttagctactattgctaa

SEQ ID NO: 4228 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 4229 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgtaccagttatgttggaccgaatgtggcgtctcttggcttgttacaatatcctcacttgttcagttcgtactcaacaaaatggaaaggttcagagactttatggtttggctactgttgctaa

SEQ ID NO: 4230 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcccagttatgttggaccgaatgttgcgtctcttggcttgttacaatatcctcacttgttcagttcgtactcaacaagatggaaagattcagagactttatggtttggctactgttgctaa

SEQ ID NO: 4231 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcatcagttatgttggaccgaatgttgcgtctcttggcttgttacaatatcctcacttgttcagttcgtacccaacaagatggaaagattcagagactttatggtttggctactgttgctaa

SEQ ID NO: 4232 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttttgttggaccgaatgttgcgtctcttggcttgttacaatatcctcacttgttcagttcgtactcaacaagatggaaagattcagagactttatggtttggctactgttgctaa

SEQ ID NO: 4233 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttgtgttggaccgaatgttgcgtctcttggcttgttacaatatcctcacttgttcagttcgtactcaacaagatggaaagattcagagactttatggtttggctactgttgctaa

SEQ ID NO: 4234 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttttaccgaatgttgcgtctctttgcttgttacaatatcctcacttgttcatttcgtactcaacaagatagaaaggttcagagactttatggtttagctactgttgctaa

SEQ ID NO: 4235 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtttgaccgaatgttgcgtctcttggcttgttacaatatcctcacttgttcagttcctactcaacaagatggaaaggttcagagactttatggtttggctactgttgctaa

SEQ ID NO: 4236 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtttgaccgaatgttgcgtctcttggcttgttacaatatcctcacttgttcatttcgtactcaacaagatggaaacattcagagactttatggtttcgctactgttactaa

SEQ ID NO: 4237 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtttgaacggaagtttcgtcccttggcctggtacaatatcctcacttgttcagttcgtactcaacaagatggaaaggttcagagactttatggtttggctactgttgctaa

SEQ ID NO: 4238 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtttgacccaatgttgcgtctcttggctttttaacatatcctcccttgttccggtcgtaatccaccagatggaaaagttcagagactttatggtttggctactgttgctaa

SEQ ID NO: 4239 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtttgaccgaatgttgcgtctcttggcttgttacaatatcctcacttgttcagttcgtactcaacaagattgaaagattcagagactttatggtttggctactgttgctaa

SEQ ID NO: 4240 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgtaccgaatattgcgtctcttggcttgttacaatatcctcacttgttcagttcgtactcaacaagatggaaagattcagagactttatggtttggctactgttgctaa

SEQ ID NO: 4241 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 4242 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaaagttcagagactttatggtttggctactgttgctaa

SEQ ID NO: 4243 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 4244 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaatatccgcacttgttcagttcgtactcaacaagatggaaaggttcagagactttatggtttggctactgttgctaa

SEQ ID NO: 4245 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4246 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4247 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4248 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcacttcgtactcaacaagatggaaaggttcagagactttatggtttggctactgttgctaa

SEQ ID NO: 4249 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 4250 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 4251 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4252 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 4253 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 4254 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 4255 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagatacagagactttatggtttggctactgttgctaa

SEQ ID NO: 4256 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4257 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 4258 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagtgactttatggtttggctactgttgctaa

SEQ ID NO: 4259 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggtactgttgctaa

SEQ ID NO: 4260 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcccttggcttgttacaataacctcacttgttcagttcgtactcaacaagatggaaaggttcagagactttatggtttggctactgttgctaa

SEQ ID NO: 4261 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaaagttcagagactttatggtttggctactgttgctaa

SEQ ID NO: 4262 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 4263 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctat

SEQ ID NO: 4264 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 4265 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacctgttcagttcgtactcaacaagatggaaagattcagagactttatggtttggctactgttgctaa

SEQ ID NO: 4266 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttagggtttggctactgttgctaa

SEQ ID NO: 4267 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatagtttggctactgttgctaa

SEQ ID NO: 4268 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacatgatggaaagattcagagactttatggtttggctactgttgctaa

SEQ ID NO: 4269 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttacgtctcttggcttgttacaatatcctcacttgttcagttcgtactcaacaagatggaaagattcagagactttatggtttggctattgttgctaa

SEQ ID NO: 4270 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagaccttatggtttggctactgttgctaa

SEQ ID NO: 4271 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacgatatcctcacttgttcagttcgtactcaacaagatggaaaggttcagagcctttatggtttggctactttgctaa

SEQ ID NO: 4272 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 4273 - DNA, 361 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgggctactgttgctaa

SEQ ID NO: 4274 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 4275 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 4276 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaaggtggaaaggttcagagactttatggtttggctactgttgctaa

SEQ ID NO: 4277 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtagtcaacaagatggaaaggttcagagactttatggtttggctactgttgctaa

SEQ ID NO: 4278 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtaatcaacaagatggaaagattcagagactttatggtttggctactgttgctaa

SEQ ID NO: 4279 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 4280 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatattctcacttgttcagttcgtactcaacaagatggaaagattcagagactttatggtttggctactgttgctaa

SEQ ID NO: 4281 - DNA, 361 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcttactgttgctaa

SEQ ID NO: 4282 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaagattcagagcctttatggtttggctactgttgctaa

SEQ ID NO: 4283 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 4284 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaccaagatggaaaagttcagagactttatggtttggctactgttgctaa

SEQ ID NO: 4285 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgatttggctactgttgctaa

SEQ ID NO: 4286 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaaggttcagagcctttatggtttggctactgttgctaa

SEQ ID NO: 4287 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgactcttggcttgttacaatatcctcacttgttcagttcgtactcaacaagatggaaaggttcagagactttatggtttggctactgttgctaa

SEQ ID NO: 4288 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 4289 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcatttgttcagttcgtactcaacaagatggaaagattcagagactttatggtttggctactgttgctaa

SEQ ID NO: 4290 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagatttagagactttatggtttggctactgttgctaa

SEQ ID NO: 4291 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtcctcaacaagatggaaaggttcagagactttatggtttggctactgttgctaa

SEQ ID NO: 4292 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagctcgtactcaacaagatggaaagattcagagactttatggtttggctactgttgctaa

SEQ ID NO: 4293 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 4294 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaagattcagagactttatggtttggctactgttgctaa

SEQ ID NO: 4295 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagtccagagactttatggtttggctactgttgctaa

SEQ ID NO: 4296 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 4297 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctac

SEQ ID NO: 4298 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttagtactcaacaagatggaaagattcagagactttatggtttggctactgttgctaa

SEQ ID NO: 4299 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttattcagttcgtactcaacaagatggaaagattcagagactttatggtttggctactgttgctaa

SEQ ID NO: 4300 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 4301 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 4302 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaagattcagagactttatggtttggctactgttgctaa

SEQ ID NO: 4303 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 4304 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 4305 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtattcaacaagatggaaaggttcagagactttatggtttggctactgttgcaa

SEQ ID NO: 4306 - DNA, 358 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggctaa

SEQ ID NO: 4307 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatagaaagattcagagactttatggtttggctactgttgctaa

SEQ ID NO: 4308 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggtttgttacaatatcctcacttgttcagttcgtactcaacaagatggaaaagttcagagactttatggtttggctactgttgctaa

SEQ ID NO: 4309 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 4310 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgatgcgtctcttggcttgttacaatatcctcacttgttcagttcgtactcaacaagatggaaaggttcagagactttatggtttggctactgttgctaa

SEQ ID NO: 4311 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatccgcacttgttcagttcgtactcaacaagatggaaaggttcagagactttatggtttggctactgttgctaa

SEQ ID NO: 4312 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtttcttggcttgttacaatatcctcacttgttcagttcgtactcaacaagatggaaaggttcagagactttatggtttggctactgttgctaa

SEQ ID NO: 4313 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcgtgttacaatatcctcacgtgttcagttcgtactcaacaagatggaaagattcagagactttatggtttggctactgttgctaa

SEQ ID NO: 4314 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgaaccgaatgttgcgtctcttggcttgttacaatatcctcacttgttcagttcgtactcaacaagatggaaagattcagagactttatggtttggctactgttgctaa

SEQ ID NO: 4315 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgaaccgaatgttgcgtcacttggcttgttacaatatcctcacttgttcagttcgtactcaacaagatggaaaggttcagagactttatggtttggctactgttgctaa

SEQ ID NO: 4316 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtgggaccgaatgttgcgtctcttggcttgttacaatatcctcacttgttcagttcgtactcaacaagatggaaaggttcagagactttatggtttggctactgttgctaa

SEQ ID NO: 4317 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 4318 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgatggaccgaatgttgcgtctcttggcttgttacaatatcctcacttgttcggttcgtactcaacaagatggaaagattcagagactttatggtttggctactgttgctaa

SEQ ID NO: 4319 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4320 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4321 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactggtgctaa

SEQ ID NO: 4322 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatacaccagttatgttggaccgaatgttgcgtctcttggcttgttacaatatcctcacttgttcagttcgtactcaacaagatggaaagattcagagactttatggtttggctactgttgctaa

SEQ ID NO: 4323 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 4324 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgacgcaccagttatgttggaccgaatgttgcgtctcttggcttgttacaatatcctcacttgttcagttcgtactcaacaagatggaaagattcagagactttatggtttggctactgttgctaa

SEQ ID NO: 4325 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4326 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4327 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4328 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccgacatctaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4329 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcagcagttatgttggaccgaatgttgcgtctcttggcttgttacaatatcctcacttgttcagttcgtactcaacaagatggaaaggttcagagactttatggtttggctactgttgctaa

SEQ ID NO: 4330 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 4331 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaagttcagagactttatggtttggctactgttgctaa

SEQ ID NO: 4332 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4333 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 4334 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcttctcttggcttgttacaatatcctcacttgttcagttcgtactcaacaagatggaaagattcagagactttatggtttggctactgttgctaa

SEQ ID NO: 4335 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4336 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4337 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttactatatcctcacttgttcagttcgtactcaacaagatggaaaagttcagagactttatggtttggctactgttgctaa

SEQ ID NO: 4338 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 4339 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 4340 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 4341 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4342 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 4343 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaagttcagagactttatggtttggctactgttgctaa

SEQ ID NO: 4344 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttaagttcgtactcaacaagatggaaagattcagagactttatggtttggctactgttgcaa

SEQ ID NO: 4345 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcctactcaacaagatggaaaggttcagagactttatggtttggctactgttgctaa

SEQ ID NO: 4346 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaattttgcgtctcttggcttgttacaatatcctcccttgttcagttcgtactcaacaagatggaaaggttcagagactttatggtttggctactgttgctaa

SEQ ID NO: 4347 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 4348 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 4349 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactgaacaagatggaaaggttcagagactttatggtttggctactgttgctaa

SEQ ID NO: 4350 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttgctactgttgctaa

SEQ ID NO: 4351 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtgtggctactgttgctaa

SEQ ID NO: 4352 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctaggcttgttacaatatcctcacttgttcagttcgtactcaacaagatggaaaggttcagagactttatggtttggctactgttgctaa

SEQ ID NO: 4353 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 4354 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4355 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 4356 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 4357 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggacctaatgttgcgtctcttggcttgttacaatatcctcacttgttcagttcgtactcaacaagatggaaaggttcagagactttatggtttggctactgttgctaa

SEQ ID NO: 4358 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatgctcacttgttctgttcgtactcaacaagatggaaaggttcagagactttatggtttggctactggtgctaa

SEQ ID NO: 4359 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcccttggcttgttacaatatcctcacttgttcagttcgtactcaacaagatggaaaggttcagagactttatggtttggctactgttgctaa

SEQ ID NO: 4360 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttattgtttggctactgttgctaa

SEQ ID NO: 4361 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 4362 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgctcagttcgtactcaacaagatggaaagattcagagactttatggtttggctactgttgctaa

SEQ ID NO: 4363 - DNA, 378 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaacttggctactgttgctaa

SEQ ID NO: 4364 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcatagactttatggtttggctactgttgctaa

SEQ ID NO: 4365 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 4366 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 4367 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 4368 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 4369 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 4370 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 4371 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 4372 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 4373 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggacctaatgttgcgtctcttggcttgttacaatatcctcacttgttcagttcgtactcaacaagatggaaagattcagagactttatggtttggctactgttgctaa

SEQ ID NO: 4374 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttataatatcctcacttgttcagttcgtactcaacaagatggaaaggttcagagcctttatggtttggctactgttgctaa

SEQ ID NO: 4375 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagcctttatggtttggctactgttgctaa

SEQ ID NO: 4376 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 4377 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 4378 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttttttactgttgctaa

SEQ ID NO: 4379 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaaagttcagagactttatggtttggctactgttgctaa

SEQ ID NO: 4380 - DNA, 357 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagagggaaagattcagagactttatggtttggctactgttaa

SEQ ID NO: 4381 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 4382 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 4383 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4384 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4385 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4386 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcccagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4387 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgctactcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4388 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgctactcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4389 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcatctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4390 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattacttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4391 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatcgcttctcagctcccaacagctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4392 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatcgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4393 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaaatgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4394 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4395 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4396 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctagtgaaattgcttctcagctcccaacaactaaccctgatgcaccagttatgttggaccgaatgttgcgtctcttggcttgttacaatatcctcacttgttcagttcgtactcaacaagatggaaagattcagagactttatggttgggctactgttgctaa

SEQ ID NO: 4397 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacatgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4398 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacatgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4399 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacatattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4400 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacatattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4401 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacatattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4402 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttaacctatttaaattgcttctcagctcccaacaactaaccctgatgcaccagtcatgttggaccgaatgttgcgtctcttggcttgttacaatatcctcccttgttctgttcgtactcaacaagatggaaagattcagagactttatggtttggcgactgttgctaa

SEQ ID NO: 4403 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctaaaatttcacctattgaaattgcttctcagctcccaacaactaaccctgatgcaacagttatgttggaccgaatgttgcgtctcttggcttgttacaatatcctcacttgttcagttcgtactcaacaagatggaaaggttcagagactttatggtttggctactgttgctaa

SEQ ID NO: 4404 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4405 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4406 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4407 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgcacaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4408 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgcacaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4409 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgatcaaatttcacctattgaaattgcttctcagctcccaacaactaaccctgatgcaccagttatgttggaccgaatgttgcgtctcttggcttgttacaatatcctctcttgttcagttcgtactcaacaagatggaaaggttcacagactttattgtttggctactgttgctaa

SEQ ID NO: 4410 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtcctcaaatttcacctgttcaaattgcttctcagctcccaacaactaaccctgatgcaccagttatgttggaccgaatgttgcgtctcttgtcttgttacaatatcctcacttgttcagttcgtactcaacaagatggaaaagttcagagactttatggtttggctactgttgctaa

SEQ ID NO: 4411 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4412 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctaccaacaactaacccttatgcaccagttatgtttaaccgaattttgcgtctcttaactttttacaatatcctcacttgttcagttcgtactcaacaaaatgtaaaggttcagagactttatggtttggctactgttgctaa

SEQ ID NO: 4413 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4414 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggagctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4415 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctagtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4416 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4417 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4418 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4419 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4420 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4421 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcatggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4422 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4423 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcatagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4424 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaataattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4425 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatcccttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4426 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatcccttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4427 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatcccttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4428 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttcatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4429 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4430 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaactcgatctcctagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4431 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacctgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4432 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttaaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4433 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttaaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4434 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctctgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4435 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4436 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcatgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4437 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattttaaaatcaactcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4438 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgatttcaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4439 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgatttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4440 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgatttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4441 - DNA, 358 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgatttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagttcagagactttatggtttggctactgttgctaa

SEQ ID NO: 4442 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4443 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgatcttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4444 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccatgactttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4445 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcccataattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4446 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttccaatgattttaaaatcagctcttgaacttgatctcttagaaatcattgctaaagctggacctggtgctcaaatttcacctattgaaattgcttctcagctcccaagaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4447 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttccaatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4448 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcacatgattttaaaatcagctcttgaacttgatctcttagaaatcattgctaaagctggacctggtgctcaaatttcacctattgaaattgcttctcagctcccaacaactaaccctgatgcaccagttattttggaccgaatgttgcgtctcttggcttgttacaatatcctcacttgttcagttcgtactcaacaagatggaaattttctgacactttatggtttggctactcttgctaa

SEQ ID NO: 4449 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttcttcacatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4450 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttctgcccatgattttaaaatcagctcgtgaacttgatctcttagaaatcattgctaaagctggacctggtgctcaaatttcacctattgaaattggttctcagctcccaacaactaaccctgatgcaccagttatgttggaccgaaagttgcgtctcttggctttttacaatatcctctcttgttcagttcgtaatcaacaagatggaatggttcagagactttattgtttggctactgttgctaa

SEQ ID NO: 4451 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttctccccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4452 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagttctacccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcgtgttacaatatcctcacttgttcagttcgtactcaacaagatggaaaggttcagagactttatggtttggctactgttgctaa

SEQ ID NO: 4453 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcttcagatcttcccctgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4454 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgctgcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4455 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagtgcatcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 4456 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagggcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4457 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4458 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4459 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagcgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4460 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4461 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgcttttgaaatcagctcttgaacttgatctcttagaaatcattgctaaagctaaacctggtcctcaaatttaacctattgtaattgcttttctgctcaccaacccgcaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4462 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4463 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 4464 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatcttttagaaatcattgctatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4465 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4466 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4467 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4468 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4469 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4470 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4471 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcagcaagatggaaagattcagagactgtatggtttggctactgttgctaa

SEQ ID NO: 4472 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4473 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4474 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4475 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4476 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattagcaaatgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4477 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattaccaagtgcttcagttcttcccatgcttttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4478 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattacaaagtgcttcagttcttcccatgattttaaaatcagctcttgaacttgatctcttagaaataattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4479 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaacaagatggaaaagttcagagactttatggtttggctactgttgctaa

SEQ ID NO: 4480 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4481 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4482 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4483 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacagctaaccctgatgcaccagttatgtgggaccgaatgttgcgtctcttggcttgttacaatatcctcactggttcagttcgtactcaacaagatggaaagattcagagactttaaggtttggctactgttgctaa

SEQ ID NO: 4484 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4485 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4486 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactatcaagtgcttcagttcttcccatgattttgaaatcagctcttgaacttgatctcttagaaatcattctaaagctggacctggtgctcaaatttcacctactgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4487 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4488 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcgagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4489 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4490 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4491 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4492 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgtttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4493 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttgagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4494 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttctgttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4495 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcggttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4496 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcggttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4497 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcggttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4498 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcggttcttcccatgattttgaaatcagctcttgaacatgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4499 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcatttcttcccatcattttgaaatcagctcttgaacttggtctcttagaaatcattgctaaagcttgacctggttctcaaatttcgcctattgaaattgcttctcagctaccaacaactaaaccttatgcaccagttatgttggacccaatgttatgtctcttcgcttattacaatatcctcccttgttcacttctttctctacaacatttaaacattcagagactttctggtttggctactgttgttaa

SEQ ID NO: 4500 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttgttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4501 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcctatgattttgaaatcagctcttgaacttgatctcttagaaatcattgctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4502 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagaatcagagactttatggtttggctactggtgctaa

SEQ ID NO: 4503 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtaatcaacaagatggaaaggttcagagactttatggtttggctactgttgcta

SEQ ID NO: 4504 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4505 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4506 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctcccaacaactaaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4507 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcgaa

SEQ ID NO: 4508 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4509 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4510 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccctgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4511 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaattcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4512 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaattcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4513 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaattagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4514 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcggctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4515 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcaggtcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4516 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcaggtcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcggagactttatggtttggctactgttgctaa

SEQ ID NO: 4517 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgatcttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4518 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttggtctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4519 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagtaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4520 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttaggaatcatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4521 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagcaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4522 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagcaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaagattcagagactttatggtttggctactgttgctaa

SEQ ID NO: 4523 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagcaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaagactcagagactttatggtttggctactgttgctaa

SEQ ID NO: 4524 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagcaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4525 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaagtcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4526 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaattattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgatgctaa

SEQ ID NO: 4527 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatctttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4528 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcgttgctaaagctggacctggtgctcaaatttcacctgttcaaattgcttctcagcttccaacaactaaccctgatgcaccagtcatgttggaccgaatgttgcgtctcttggcttgttacaatagcctcacttgttctgttcgtactcaacaagatggaaaggttcagagactttatggtttggctactgttgctaa

SEQ ID NO: 4529 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4530 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4531 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4532 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4533 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctgttcaaattgcttctcagcttccaacaactaaccctgatgcaccagtcatgttggacagaatgttgcgtctcttggcttgttacaatatcctcacttgttctgttcgtactctagaagatggaaaggttcagagaatttatggtttggctacttttgctaa

SEQ ID NO: 4534 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4535 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4536 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4537 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctattgaaattgcttctcagctcccaacaactaaccctgatgcaccagttatgttggaccgaatgttgcgtctcttggcttgtacaatatcctcacttgttcagttcgtactcaacaagatggaaagattcagagactttatggtttggctactgttgctaa

SEQ ID NO: 4538 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcgacaagatggaaagattcagagactttatggtttggctactgttgctaa

SEQ ID NO: 4539 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacagttgctaa

SEQ ID NO: 4540 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4541 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4542 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4543 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggttggctactgttgctaa

SEQ ID NO: 4544 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagcttgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4545 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4546 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctatggaaattgcttctcagctaccaacaactaaccctgatgcaccagttatgttggaccgaatgttgcgtctctgggctggttacaatatcctcacttgttcagttcgtactcaacaagatggaaaggttcagagactttatggtttggctactgttgctaa

SEQ ID NO: 4547 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggtcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4548 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4549 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4550 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacttggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4551 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctgttgctcaaatttcacctatggaaattgcttctcagctcccaacaactaaccctgatgcaccagttatgttggaccgaatgttgcgtctcttggcttgttacaatatcctcacttgttcagttcgtactcaacaagatggaaaggttgagagtctttttggtttggcgactggtgctaa

SEQ ID NO: 4552 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggttctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4553 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcagatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4554 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttgacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4555 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctcccaacaactaaccctgatgcaccagttatgttggaccgaatgttgcgtctcttggcttgttacaatatcctcacttgttcagttcgttctcaacaatatggtatgtttcagagactttatcgtttggctcctgttactaa

SEQ ID NO: 4556 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4557 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttccctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4558 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcatctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4559 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcatctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4560 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacagctaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4561 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctggtgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4562 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4563 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4564 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaagggttcagagactttatggtttggctactgttgctaa

SEQ ID NO: 4565 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4566 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4567 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4568 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4569 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 4570 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagtgcgttcgcaacaagctggaaaggtgcagagccgttatggtgtggcgactgttactaa

SEQ ID NO: 4571 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggatcgaatgttgcgtctcttggcttgttacaatatcctcacttgttctgttcgtactcaacaagatggaaaggttcagagactttatggtttggctactgttgctaa

SEQ ID NO: 4572 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 4573 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcctggcttgttacaatatcctcacttgttctgttcgtactcaacaagatggaaagattcagagactttatggtttggctactgttgctaa

SEQ ID NO: 4574 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4575 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4576 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4577 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4578 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4579 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttcccagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4580 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttaaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 4581 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacattgcttctcagctaccaacaactaaccctgatgcaccagttatgttggaccgaatgttgcgtctcttggcttgttacaatatcctcacttgttcagttcgtactcaacaagatggaaaggttcagagactttatggtttgggtactgttgctaa

SEQ ID NO: 4582 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4583 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4584 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4585 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattggttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4586 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttttcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4587 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttgtcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4588 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4589 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4590 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaacaactaaccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 4591 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4592 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4593 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4594 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4595 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4596 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4597 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4598 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 4599 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 4600 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttccgttcgtactcaacaagatggaaaggttcagagactttatggtttggctactgttgctaa

SEQ ID NO: 4601 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 4602 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 4603 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctctcaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4604 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 4605 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaaggttcagagactttatggtttggctactgttgctaa

SEQ ID NO: 4606 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgtttgaccgaatttttcttctcttggcttgttacaatatcctcacttgttcagttcgtactcaacaagatgtaaaagttcacaaactttatggtttggctactgttgctaa

SEQ ID NO: 4607 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4608 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctag

SEQ ID NO: 4609 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4610 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 4611 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagcgactttatggtttggctactgttgctaa

SEQ ID NO: 4612 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4613 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagtttcagagactttatggtttggctactgttgctaa

SEQ ID NO: 4614 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 4615 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4616 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 4617 - DNA, 358 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtgcagagactttatggtttggctactgttgca

SEQ ID NO: 4618 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttgagttcgtactcaacaagatggaaagattcagagactttatggtttggctactgttgctaa

SEQ ID NO: 4619 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 4620 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgtcgctaa

SEQ ID NO: 4621 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 4622 - DNA, 356 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttg

SEQ ID NO: 4623 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 4624 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 4625 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagtctttatggtttggctatgttgctaa

SEQ ID NO: 4626 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 4627 - DNA, 358 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcctgttgctaa

SEQ ID NO: 4628 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4629 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 4630 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 4631 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttgggttgttacaatatcctcacttgttcagttcgtactcaacaagatggaaaggttcagagactttatggtttggctactgttgctaa

SEQ ID NO: 4632 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaagttcagagactttatggtttggctactgttctaa

SEQ ID NO: 4633 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 4634 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 4635 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 4636 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggatactgtggctaa

SEQ ID NO: 4637 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacatgatggaaaggttcagagactttatggtctggttactgttgctaa

SEQ ID NO: 4638 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtatgggtactgttgctaa

SEQ ID NO: 4639 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagtttcagagcctttattgtttggctactgttgctaa

SEQ ID NO: 4640 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgatacaatatcctcacttgttcagttcgtactcaacaagatggaaagattcagagactttatggtttggctactgttgctaa

SEQ ID NO: 4641 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctcgttacaatatcctcacttgttcagttcgtactcaacaagatggaaagattcagagactttatggtttggctactgttgctaa

SEQ ID NO: 4642 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatattctcacttgttcagttcgtactcaacaagatggaaagattcagagactttatggtttggctactgttgctaa

SEQ ID NO: 4643 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 4644 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 4645 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 4646 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 4647 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttcctaa

SEQ ID NO: 4648 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 4649 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 4650 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagctcgtactcaacaagatggaaagattcagagactttatggtttggctactgttgctaa

SEQ ID NO: 4651 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctattgttgctaa

SEQ ID NO: 4652 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcatagactttatggtttggctactgttgctaa

SEQ ID NO: 4653 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaagattcagagactttatggtttggctactgttgctaa

SEQ ID NO: 4654 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcatagactttatggtttggctactgttgctaa

SEQ ID NO: 4655 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 4656 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 4657 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 4658 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgctgcgtctcttggcttgttacaatatcctcacttgttcagttcgtactcaacaagatggaaagattcagagactttatggtttggctactgttgctaa

SEQ ID NO: 4659 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 4660 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 4661 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 4662 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgaccgaatgttgcgtctcttggcttgttacaatatcctcacttgttcagttcgtactcaacaagatggaaaggttcagagactttatggtttggctactgttgctaa

SEQ ID NO: 4663 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgtgggaccgaatgttgcgtctcttggcttgttacaatatcctcacatgttcagttcgtactcaacaagatggaaagattcagagactttatggtttggctactggtgctaa

SEQ ID NO: 4664 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgctggaccgaatgttgcgtctcttggcttgttacaatatcctcacttgttcagttcgtactcaacaagatggaaagattcagagactttatggtttggctactgttgctaa

SEQ ID NO: 4665 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgatggaccgaatgttgcgtctcttggcttgttacaatatcctcacttgttcagttcgtactcaacaagatggaaaggttcagagactttatggtttggctactgttgctaa

SEQ ID NO: 4666 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4667 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4668 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 4669 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 4670 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4671 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4672 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4673 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4674 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4675 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4676 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4677 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 4678 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 4679 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcatcagttatgttggaccgaatgttgcgtctcttggcttgttacaatatcctcacttgttcagttcgtactcaacaagatggaaaggttcagagactttatggtttggctactgttgctaa

SEQ ID NO: 4680 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttgtgttggaccgaatgttgcgtctcttggcttgttacaatatcctcacttgttcagttcgtactcaacaagatggaaaggttcagagactttatggtttggctactgttgctaa

SEQ ID NO: 4681 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttttaccgaatttttcgtctcttggcttgttacaatatcctcacttgttcagttcgtactcaacaagattgaaaggttcagagactttatggtttcgctactgttgctaa

SEQ ID NO: 4682 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttttaccgaattttgcctctcttagctttttacaatatcctcacttgttcatttcgtactcaacaagatggaaatgttcagagactttatgctttggctactgtgctaa

SEQ ID NO: 4683 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttcagttcttactcaacaagattgaaaggttcagagactttatggtttggctactgttgctaa

SEQ ID NO: 4684 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 4685 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4686 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4687 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4688 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4689 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4690 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 4691 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 4692 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 4693 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacttaacaagatggaaaggttcagagactttatggtttggctactgttgctaa

SEQ ID NO: 4694 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaataccctcacttgttcagttcgtactcaacaagatggaaaggttcagagactttatggtttggctactgttgctaa

SEQ ID NO: 4695 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttgcaatatcctcacttgttctgttcgtactcaacaagatggaaaggttcagagactttatggtttggctactgttgctaa

SEQ ID NO: 4696 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatcgaaaggtccagagactttatggtttggctactgttgctaa

SEQ ID NO: 4697 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaaagttcagagactttatggtttggctactgttgctaa

SEQ ID NO: 4698 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 4699 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttacgtctcttggcttgttacaatatcctcacttgttcagttcgtactcaacaagatggaaagattcagagactttatggtttggctactgttgctaa

SEQ ID NO: 4700 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 4701 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 4702 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 4703 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 4704 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 4705 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 4706 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 4707 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgctgctaa

SEQ ID NO: 4708 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 4709 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcggctcttggcttgttacaatatcctcccttgtttagttcgttctcaaccagatggaaagggtcagagactttatggtttggctactgttgctaa

SEQ ID NO: 4710 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 4711 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggctcagagactttatggtttggctactgttgctaa

SEQ ID NO: 4712 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaatatggaaaggttcagagactttatggtttggctactgttgctaa

SEQ ID NO: 4713 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 4714 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggacctaatgttgcgtctcttggcttgttacaatatcctcacttgttcagttcgtactcaacaagatggaaaggttcagagactttatggtttggctactgttgctaa

SEQ ID NO: 4715 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtgacaatatcctcacttgttcagttcgtactcaacaagatggaaaggttcagagactttatggtttggctactgttgctaa

SEQ ID NO: 4716 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcttactcaacaagatggaaaggttcagagactttatggtttggctactgttgcta

SEQ ID NO: 4717 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 4718 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 4719 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaagttcagagactttatggtttggctactgttgctaa

SEQ ID NO: 4720 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtcgctaa

SEQ ID NO: 4721 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaaagttcagagactttatggtttggctactgttgctaa

SEQ ID NO: 4722 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 4723 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttcggctactgttgctaa

SEQ ID NO: 4724 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaggatggaaaggttcagagactttatggtttggctactgttgctaa

SEQ ID NO: 4725 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgcactcaacaagatggaaaagttcagagactttatggtttggctactgttgctaa

SEQ ID NO: 4726 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaagttcagagactttatggtttggctactgttgctaa

SEQ ID NO: 4727 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 4728 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggattgttacaatatcctcacttgttcagttcgtactcaacaagatggaaaggttcagagactttatggtttggctactgttgctaa

SEQ ID NO: 4729 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 4730 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgttctcaacaagatggaaaagttcagagactttatggtttggctactgttgctaa

SEQ ID NO: 4731 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 4732 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 4733 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 4734 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcatcacttgttcagttcgtactcaacaagatggaaaggttcagagactttatggtttggctactgttgctaa

SEQ ID NO: 4735 - DNA, 363 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggtggctactgttgctaa

SEQ ID NO: 4736 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaagattcagagactttatggtttggctactgttgctaa

SEQ ID NO: 4737 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 4738 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaagttcagagactttatggtttggctactgttgctaa

SEQ ID NO: 4739 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggactgaatgttgcgtctcttggcttgttacaatatcctcacttgttcagttcgtactcaacaagatggaaagattcagagactttatggtttggctactgttgctaa

SEQ ID NO: 4740 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaagattcagagcctttatcgtttggctactgttgctaa

SEQ ID NO: 4741 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaaggttcagagactttatggtttggctactgttgctaa

SEQ ID NO: 4742 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctaggcttgttacaatatcctcacttgttcagttcgtactcaacaagatggaaaggttcagagactttatggtttggctactgttgctaa

SEQ ID NO: 4743 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggcttggctactgttgctaa

SEQ ID NO: 4744 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtttctaa

SEQ ID NO: 4745 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 4746 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgtggctaa

SEQ ID NO: 4747 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtagctaa

SEQ ID NO: 4748 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctaccgttgctaa

SEQ ID NO: 4749 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatagcctcacttgttcagttcgtactcagcaagatggaaaggttcagagactatatggtttggctactgttgctaa

SEQ ID NO: 4750 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 4751 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacacaacaagatggaaaggttcagagactttatggtttggctactgttgctaa

SEQ ID NO: 4752 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaagttcagagactttatggtttggctactgttgctaa

SEQ ID NO: 4753 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgtcttgttacaatatcctcacttgttcagttcgtactcaacaagatggaaagattcagagactttattgtttggctactggtgctaa

SEQ ID NO: 4754 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggctcagagactttatggtttggctactgttgctaa

SEQ ID NO: 4755 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcgtgggacaagatcctcactggggaagggcggactcaacaagatggaaagattcagagactttatggtttggctactgttgctaa

SEQ ID NO: 4756 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 4757 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtttgtactcaacaagatggaaaggttcagagactttatggtttggctactgttgctaa

SEQ ID NO: 4758 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 4759 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagaaactttatggtttggctactgttgctaa

SEQ ID NO: 4760 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcgtgttacaatatcctcacttgttgagttcgtactcaacaagatggaaaagttcagagactttatggtttggctactgttgctaa

SEQ ID NO: 4761 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 4762 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 4763 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggatggttacaatatcctcacttgttcagttcgtactcaacaagatggaaaggttcagagactttatggtttggctactgttgctaa

SEQ ID NO: 4764 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 4765 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctaatgttgctaa

SEQ ID NO: 4766 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 4767 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgactcttggcttgttacaatatcctcacttgttcagttcgtactcaacaagatggaaaggttcagagactttatggtttggctactggtgctaa

SEQ ID NO: 4768 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttattcagttcgtactcaacaagatggaaaagttcagagactttatggtttggctactgttgctaa

SEQ ID NO: 4769 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgaaccgaatgttgcgtctcttggcttgttacaatatcctcacttgttcagttcgtactcaacaagatggaaaagttcagagactttatggtttggctactgttgctaa

SEQ ID NO: 4770 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgtgggaccgaatgttgcgtctcttggcttgttacaatatcctcacttgttcagttcgtactcaacaagatggaaagattcagagactttatggtttggctactgttgctaa

SEQ ID NO: 4771 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgtgggaccgaatggtgcgtcgcttggcttggtacaatatcctcagttgttcagttcgtactcaacaagatggaaaggttaagagaggttatgggttggcgactgttgctaa

SEQ ID NO: 4772 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgctggaccgaatgttgcgtctcttggcttgttacaatatcctcacttgttcagttcgtactcaacaagatggaaaggttcagagactttatggtttggctactgttgctaa

SEQ ID NO: 4773 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4774 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4775 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctgctgttgataa

SEQ ID NO: 4776 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 4777 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4778 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaccaagatggaaaggttcagagactttatggtttggctactgttgctaa

SEQ ID NO: 4779 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 4780 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatccaccagttatgttggaccgaatgttgcgtctcttggcttgttacaatatcctcacttgttcagttcgtactcaacaagatggaaaggttcagagactttatggtttggctactgtcgctaa

SEQ ID NO: 4781 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 4782 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4783 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4784 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccagatgcaccagttatgttggtccgaatttttcgtctcgtggctggttacaatatcctcacttgttcagttcgtactcagcaagatggaaaagttcagagactttatggtttcgctactgttgcaaa

SEQ ID NO: 4785 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4786 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcacctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4787 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaactaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4788 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgctcctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4789 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcgtctcagctaccaacaactaaccctgatgcaccagttatgttggaccgaatgttgcgtctcttggcttgttacaatatcctcccttgttcagttcgtactcaacaagatggaaaagttcagagactttatggtttggctactgttgctaa

SEQ ID NO: 4790 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcatctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4791 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattccttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4792 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattacttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4793 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattacttctcagctaccaacaactaaccctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 4794 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4795 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4796 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4797 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacccattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4798 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaattacacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4799 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4800 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4801 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgcacaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4802 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgcacaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4803 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4804 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtcctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4805 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtcctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4806 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtcctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4807 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4808 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttgctactgttgctaa

SEQ ID NO: 4809 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4810 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatttcctcgcttgttcagttcgtactaaacaagatggaaaggttcagagactttatggtttggctactgttgctaa

SEQ ID NO: 4811 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggggctcaaatttcacctattgaaattgcttctcagctaccaacaactaaccctgatgcaccagttatgttggaacgaatgttgcgtctcttggcttgttacaatatcctcacttgttcagttcgtactcaacaagatggaaaagttcagagcctttatggtttggctactgttgataa

SEQ ID NO: 4812 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggagctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4813 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggagctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4814 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctgctgctcaaatttcacctattgaaatttcttctcagctaccaacaactaaccctgatgcaccagttatgttttaccgaatattgcatctcttggcttattacaatatcctcacttgttcagttcgtactcaacaagatggaaacattcagagactttatggtttggctactgttgctaa

SEQ ID NO: 4815 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctgatgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4816 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4817 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4818 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4819 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 4820 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4821 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagcgggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatagaaaggttcagagacttgatgatttggcgactgttactaa

SEQ ID NO: 4822 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4823 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgccaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4824 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4825 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4826 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcatggctaaagctggacctggttctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactggtgctaa

SEQ ID NO: 4827 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttaaaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4828 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4829 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4830 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatcccttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4831 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttaatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4832 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacgtgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4833 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacctgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4834 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacatgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4835 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctcccaacaagtaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4836 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4837 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcctgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggtgactgatgctaa

SEQ ID NO: 4838 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcctgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4839 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcatgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4840 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagcgcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4841 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4842 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcggctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4843 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttggacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4844 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttggtctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4845 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagcaatcattgctaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4846 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagcaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4847 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4848 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4849 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaactttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4850 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcgcctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4851 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4852 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4853 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4854 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggctcgttacaatatcctcacttgttcagttcgtactcaacaagatggaaagattcagagactttatggtttggctactgttgctaa

SEQ ID NO: 4855 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4856 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4857 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4858 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 4859 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4860 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaattttgcgtcacttggctggttacaatatcctcacttgttcagttcgttctctacaagactgaaaggttcagaggctttatcgtttggcagctgtggctaa

SEQ ID NO: 4861 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4862 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4863 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4864 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4865 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttgtcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4866 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4867 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctacgttgctaa

SEQ ID NO: 4868 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4869 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4870 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4871 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4872 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4873 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatgtcctcacttgttcagttcgtactcaacaagatggaaagattcagagactttatggtttggctactgttgctaa

SEQ ID NO: 4874 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 4875 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaaagttcagagactttatggtttggctactgttgctaa

SEQ ID NO: 4876 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4877 - DNA, 358 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggactgttgctaa

SEQ ID NO: 4878 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaagattcagagactttatggtttggctactgttgctaa

SEQ ID NO: 4879 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgatgctaa

SEQ ID NO: 4880 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 4881 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtaacaatatcctcacttgttcagttcgtactcaacaagatggaaagattcagagactttatggtttggctactgttgctaa

SEQ ID NO: 4882 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaagattcagagactttatggtttggctactgttgctaa

SEQ ID NO: 4883 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattccgagactttatggtttggctactgttgctaa

SEQ ID NO: 4884 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaaagttcagagactttatggtttggctactgttgctaa

SEQ ID NO: 4885 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgaaccgaatgttgcgtctcttggcttgttacaatatcctcacttgttcagttcgtactcaacaagatggaaagattcagagactttatggtttggctactgttgctaa

SEQ ID NO: 4886 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4887 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 4888 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4889 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttctgttcgtactcaacaagatggaaaggttcagagactttatggtttggctactgttgctaa

SEQ ID NO: 4890 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4891 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4892 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4893 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 4894 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 4895 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4896 - DNA, 358 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtgcagagactatggtttggctactgttgctaa

SEQ ID NO: 4897 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttagctactgttgctaa

SEQ ID NO: 4898 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 4899 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4900 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagtttagagactttatggtttggctactgttgctaa

SEQ ID NO: 4901 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcgtcacttgttcagttcgtactcaacaagatggaaaggttcagagactttatggtttggctactgttgctga

SEQ ID NO: 4902 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagttggaaaggttcagagactttatggtttggctactgttgctaa

SEQ ID NO: 4903 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 4904 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggagaggttcagagactttatggtttggctactgttgctaa

SEQ ID NO: 4905 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatattggaccgaatgttgcgtctcttggcttgttacaatatcctcacttgttcagttcgtactcaacaagatggaaaagttcagagactttatggtttggctactgttgctaa

SEQ ID NO: 4906 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4907 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4908 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4909 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 4910 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4911 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4912 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4913 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgccaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4914 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgccaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 4915 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatcccttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4916 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgacctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4917 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacctgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4918 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcaactcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4919 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattttaaaatcaactcttgaacttgatctcttagaaatcattgctaaagctagacctggtgctaaaaattcaactattgaaattacttcactgctcccaacaactaaccctgatgcaccagttatgttggacccaatattgcgtcacatggacagttacaatagcctcacttgttcagttcgtactaaacaagaaggaaaggttaagagactttatggttaggctactgttgctaa

SEQ ID NO: 4920 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattatgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4921 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgattatgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4922 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccatgactttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4923 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcccacgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4924 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcttcacatgattttgaaatcagctcttgaacttgatctcttagaaatcattgctaaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaagagtcagagactttatggtttggctactgttgctaa

SEQ ID NO: 4925 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttctccccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4926 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttctccccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4927 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagttcctcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4928 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcagatcttcccatgattttgaaatcagctcttgaacttgatctcttagaaatcattgctaaagctggacctggtgctcaaatttcacctattgaaatttcttctcatctcccaacaactaaccctgatgcaccagttatgttggaccgaatgttgcgtctcttggcttgttacaatatcctcacttgttcagttcgtactcaacaagatggaaagattcagagactttattgtttggctactgttgctaa

SEQ ID NO: 4929 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttcacttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4930 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcttaagttcttcccatgattttgaaatcagctcttgaacttgatctcttagaaatcattgctaaagctggacctggtgcccaaatttcacctattgaaattgcttctcagctaccaacaactaaccctgatgcaccagttatattggaccgaatgttgcgtctcttggcttgttacaatatcctcacttgttcagttcgtactcaacaagatggaaaggttcagagactttatggtttggctactgttgctaa

SEQ ID NO: 4931 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgctgcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4932 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgctccagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4933 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgctccagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4934 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgctacagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4935 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcgtcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4936 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagtgcctcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4937 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 4938 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4939 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4940 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagggcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4941 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagagcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4942 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4943 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4944 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 4945 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4946 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 4947 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactagaaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4948 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactaccaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttattttggaccgaatgttgcgtctcttggcttgttacaatatcctcacttgttcagttcgtactcaacaagatggaaagattcagagactttatggtttggctactgttgctaa

SEQ ID NO: 4949 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 4950 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 4951 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatacaattagcaagtgcttcagttcttcccatgattttgaaatcagctcttgaacttgatctcttagaaatcattgctaaagctggacctggtgctcaaatttcacctattgaaattgcttctcagctcccatcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4952 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatacaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4953 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4954 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4955 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4956 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4957 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4958 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4959 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4960 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4961 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4962 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgacatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4963 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgacatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 4964 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgacatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4965 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcgacatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4966 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttccccatgcaactagcaagagcttcagttcttcccatgattttgaaatcagctcttgaacttgatctcttagaaatcattgctaaagctgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4967 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcaccatgcaattagcaagtgcttcagttcttcccatgattttgaaatcagctcttgaacttgatctcttagaaatcattgctaaagctggacgtggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4968 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4969 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 4970 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4971 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4972 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctctacgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4973 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcgtcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4974 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcgtcgccatgcaattagcaagtgcttcagttcttcccatgattttaaaatcagctcttgaacttgatctcttagaaatcattgctaaagctgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4975 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcgtcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4976 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcgtcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 4977 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcgtcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4978 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcgtcgccatgcaactagcaagcgcttcagttcttcccatgattttaaaatcagctcttgaacttgatctcttagaaatcattgctaaagcttgacctgatgctcaaatttcacctattgaaattgcttctcagctcccaacaactaaccctgatgcaccagttatgttggaccgaatattgcgtctcttggcttgttacaatatcctcacttgttcagttcgtactcaacaagatggaaagattcagagactttatggtttggcaactgttgctaa

SEQ ID NO: 4979 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcctcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4980 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctcatcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4981 - DNA, 358 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctattcgccatgcaactagcaagagcttcagttcttcccatgcttttgaaatcatctcttgaacttgatctcttagaaatcattgctaaagctgaacctggttctcatatttcaccttttgaaattgcttctcagctaccaacaactaacccttatgcaccatttattttggaccgaatgttgcctcttggcttgttacaatatcctcacttgttcagttcgtactcaacaagatggaaaggttcagagactttatggtttggctactgttgctaa

SEQ ID NO: 4982 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacctattcgccatgcaactagcaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgtcgcgtctcttggcttgttacaatatcctctcttgttcagttcgtcctcaacaagatggaaaggttcagagactttatggtttggctactgttgctaa

SEQ ID NO: 4983 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacatcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 4984 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacatcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4985 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacatcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4986 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacatcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4987 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacatcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4988 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacatcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4989 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacatcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 4990 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacatcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4991 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaacatcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4992 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaaactcttcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 4993 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaaactcttcgccatgcaattaccaatagcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4994 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagcaaaaatcttcgccatccaactagcaagtgcttctgttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4995 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagaaaacctcttcgccatgcaactagcaagtgcttcagttcttcacatgattttgaaatcagctcttgaacttgatctcttagaaatcattgctaaagctggacctggtgctcaaatttcacctattgaaattgcttatcagctcccaacaactaaccctgatgcaccagttatcttggaccgaatgttgcgtctcttggcttgttacaatatcctcactttttctgttcgtactcaacaagatggaaatattccgatactttatggtttggctacttttgctaa

SEQ ID NO: 4996 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaagaaaaactaaacgccatgcaattagaaagagcatcagttcttcccatgattttgaaatcagcacttgaacttgatctcttagaaatcattgctaaagctggacctggtgctcaaatttcacctattgaaattgcttctcagctcccaacacctaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 4997 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaaccacacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcacaacaactaaccctgatgcaccacttatgttggaccgaatgttgcgtcgcttggcttggtacaatatcctcacttgtacggtacgtactcaacaagaaggaaaggttcagagactttagagttcggtaactgtgtctaa

SEQ ID NO: 4998 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaaccaaacctcttcgccatgcaattagcaagtgcttcagttcttcccatgattttaaaatcagctcttgaacttgatctcttagaaatcatggctagagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaagattcagagactttatggtttggctactgttgctaa

SEQ ID NO: 4999 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaaacaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5000 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5001 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5002 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaagaaacaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5003 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagatgaaaaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 5004 - DNA, 359 bp, Artificial
  MsCOMT deletion introduced by TALEN pair MsCOMT_T01.1
tctcacaaaaacctcatcaatcacaaccatgggttcaacaggtgaaactcaaataacccacatatcagacgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggttggctactgttgctaa

SEQ ID NO: 5005 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcagaagaagaagtaaacctcttcgccatgcaattagcaagtgcttcagttcttcacatgattttaaaatcagctcttgaacttgatctcttagaaatcattgctaacgctggacctggttctcaaatttcacctattgaaattgcttctcagctaccaacaactaaccctgatgcaccagttatgttggaccgcatgtttcgtctcttatcttgccccaagacccgcacgggggcaggccgtactcaacaagatggaaaatttccacccctttatggtttggctactgttgctaa

SEQ ID NO: 5006 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcaaatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5007 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcaaatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5008 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatcaaatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5009 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatatacgatgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5010 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatataagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagggactttatggtttggctactgttgctaa

SEQ ID NO: 5011 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatataagatgaagaagcaaacctcttcgccatgcaattagaaagtgcttgagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5012 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatataagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcgtgttacaatatcctcacttgttcagttcgtactcaacaagatggaaagattcagaacctttatggtttggctactgttgctaa

SEQ ID NO: 5013 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatataagatgaagaagaaaaactattcgccatgcacttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5014 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatataaaatgaagatgcaaacctaatccccatgcacttaccaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5015 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatacccgttgaagaagcaaaactaatccccatgcaactagcaagagcttcagctcttcccatgcttttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5016 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatacccgatgaagaagcaaacctcatcgccatgcaattagcaattgcttcagttcttcccatgcttttaaaagcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5017 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacataccagatgaagaagcaaacctcttcgccatgcaattagcaagtgcttcagttcttcccatgattttaaaagcagctcttgaacttgttcttttagaaatcattgctaaagctggaccgggtgctcaaatttcacctgtgcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5018 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacataccagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5019 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacataccagatgaagaagaaaacctcttcgccatgcaattagcaagagcttcagttcttgccatgcttttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5020 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacatacaagatgaagaagcaaacctcttcgccatgcaactaccacgagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5021 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacataacagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5022 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacataacagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5023 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacagatcagatgaagaagcaaacctcttcgccatgcaattagcaagggcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5024 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacagatcagatgaagaagcaaacctcttcgccatgcaattagcaagggcttcagttcttcccatgattttaaaatcagctcttgaacttgatctcttagaaatcattgctaaagctggacctggagctcgaatttcacctgttcaaattccttcacagcttccaacaactaaccctgaggcaccagtcatgttggtccgaatgttgcaactctgggcttgtttcaatatcctcacttgttctgttcgtactcaacaagattgaaaggttcagagactttatggtttggcgactgttgcgaa

SEQ ID NO: 5025 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacacatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5026 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacacataaattgaagaagcaaacgtcttcgtcatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5027 - DNA, 360 bp, Artificial
  MsCOMT deletion introduced by TALEN pair MsCOMT_T01.1
tctcacaaaaacctcatcaatcacaaccatgggttcaacaggtgaaactcaaataacccacacaccaattgaagatgcaaacctcttcgccatccaactaccattagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5028 - DNA, 364 bp, Artificial
  MsCOMT deletion introduced by TALEN pair MsCOMT_T01.1
tctcacaaaaacctcatcaatcacaaccatgggttcaacaggtgaaactcaaataacccaaccacatatcagatgtagaagagaacatcttcgccacgcacttatcaaaagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5029 - DNA, 360 bp, Artificial
  MsCOMT deletion introduced by TALEN pair MsCOMT_T01.1
tctcacaaaaacctcatcaatcacaaccatgggttcaacaggtgaaactcaaataacccaaatctaagttgaagaagcaaacctcttcgccatgcaattagaaattgcttcagttcatcccatgattttaaaatcagctcttgaacttgatctcttagaaatcaatgctaaagctggacctggtgctcaaatttcacctgttcaaattgcttctcagtttccaacaactaaccctgatgcacaagtcatgttggaccgaatgttgcgtctcttggcttgttacaatatcctcacttgttctgttcgtactcaacaagatggaaaggttcagagactttatggtttggctactgttgctaa

SEQ ID NO: 5030 - DNA, 360 bp, Artificial
  MsCOMT deletion introduced by TALEN pair MsCOMT_T01.1
tctcacaaaaacctcatcaatcacaaccatgggttcaacaggtgaaactcaaataacccaaatatcagatgaagaagcaaacatcttcgccatgcaactagcaagtgcttcagttcttcccatgattttgaaatcagctcttgaacttgatctcttagaaatcatttctaaagctggacctggtactcaaatttcacctattgaaattgcttctcagctaccaacaactaaccctgatgcaccagttatgttggaccgaatgttgcgtctcttggctttttacaatatcctcacttgttcagttcgtactcaacaagatggaaaagttcagagactttatggtttggctactggtgctaa

SEQ ID NO: 5031 - DNA, 360 bp, Artificial
  MsCOMT deletion introduced by TALEN pair MsCOMT_T01.1
tctcacaaaaacctcatcaatcacaaccatgggttcaacaggtgaaactcaaataacccaaatatcagatgaagaagaaaacctattcgccatgcaactagcaagtgcttcagttcttcccatgattttgaaatcagctcttgaacttgatctcttagaaatcattgctaaagctgaacctggtgctcaaatttcacctattgaaattgcttctcagccaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5032 - DNA, 360 bp, Artificial
  MsCOMT deletion introduced by TALEN pair MsCOMT_T01.1
tctcacaaaaacctcatcaatcacaaccatgggttcaacaggtgaaactcaaataacccaaatatcaaatgaagaagcaaaactcttcgccatgcaattagcaagagcatcagttcttcccatgattttaaattcaaatcttgaacttgatctcttagaaattattgctatagctgaacctggtgctcaaatttcacctattgaaattgattctcagctcccaacaactaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5033 - DNA, 360 bp, Artificial
  MsCOMT deletion introduced by TALEN pair MsCOMT_T01.1
tctcacaaaaacctcatcaatcacaaccatgggttcaacaggtgaaactcaaataacccaaacataagatgaagaagcaaacccatacgccatgcaaatacaatgagcatcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5034 - DNA, 364 bp, Artificial
  MsCOMT deletion introduced by TALEN pair MsCOMT_T01.1
tctcacaaaaacctcatcaatcacaaccatgggttcaacaggtgaaactcaaataaccagcccacatatcagataaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaattttgcgtctcttgggttgttacaatatcctcacttgttcagttcgtactcaacaagatggaaaggttcagagactttatggtttggctactgatgctaa

SEQ ID NO: 5035 - DNA, 393 bp, Artificial
  MsCOMT deletion introduced by TALEN pair MsCOMT_T01.1
tctcacaaaaacctcatcaatcacaaccatgggttcaacaggtgaaactcaaataaccaccgctggtagctgtggtttttttgtttgcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5036 - DNA, 393 bp, Artificial
  MsCOMT deletion introduced by TALEN pair MsCOMT_T01.1
tctcacaaaaacctcatcaatcacaaccatgggttcaacaggtgaaactcaaataaccaccgctggtagcggtggtttttttgtttgcacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5037 - DNA, 393 bp, Artificial
  MsCOMT deletion introduced by TALEN pair MsCOMT_T01.1
tctcacaaaaacctcatcaatcacaaccatgggttcaacaggtgaaactcaaataaccaccgctggtagcggtggtttttttgtttgcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5038 - DNA, 393 bp, Artificial
  MsCOMT deletion introduced by TALEN pair MsCOMT_T01.1
tctcacaaaaacctcatcaatcacaaccatgggttcaacaggtgaaactcaaataaccaccgctggtagcggtggtttttttgtttgcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtgggaccgaatgttgcgtcgcttggcttgttacaatatcctcacttgttcagttcgtactcaacaagatggaaaggttcagagactttatggtttggctactgttgctaa

SEQ ID NO: 5039 - DNA, 393 bp, Artificial
  MsCOMT deletion introduced by TALEN pair MsCOMT_T01.1
tctcacaaaaacctcatcaatcacaaccatgggttcaacaggtgaaactcaaataaccaccgctggtagcggtggtttttttgtttgcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5040 - DNA, 393 bp, Artificial
  MsCOMT deletion introduced by TALEN pair MsCOMT_T01.1
tctcacaaaaacctcatcaatcacaaccatgggttcaacaggtgaaactcaaataaccaccgctggtagcggtggtttttttgtttgcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5041 - DNA, 393 bp, Artificial
  MsCOMT deletion introduced by TALEN pair MsCOMT_T01.1
tctcacaaaaacctcatcaatcacaaccatgggttcaacaggtgaaactcaaataaccaccgctggtagcggtggtttttttgtttgcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5042 - DNA, 393 bp, Artificial
  MsCOMT deletion introduced by TALEN pair MsCOMT_T01.1
tctcacaaaaacctcatcaatcacaaccatgggttcaacaggtgaaactcaaataaccaccgctggtagcggtggtttttttgtttgcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5043 - DNA, 393 bp, Artificial
  MsCOMT deletion introduced by TALEN pair MsCOMT_T01.1
tctcacaaaaacctcatcaatcacaaccatgggttcaacaggtgaaactcaaataaccaccgctggtagcggtggtttttttgtttgcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5044 - DNA, 392 bp, Artificial
  MsCOMT deletion introduced by TALEN pair MsCOMT_T01.1
tctcacaaaaacctcatcaatcacaaccatgggttcaacaggtgaaactcaaataaccaccgctggtagcggtggtttttttgtttgcacccacatatcagatgaagaagcaaacctcttcgccatgcaactagcaagtgcttcagttcttcccatgattttgaaatcagctcttgaacttgatctcttagaaatcattgctaaagctgcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgtaa

SEQ ID NO: 5045 - DNA, 393 bp, Artificial
  MsCOMT deletion introduced by TALEN pair MsCOMT_T01.1
tctcacaaaaacctcatcaatcacaaccatgggttcaacaggtgaaactcaaataaccaccgctggtagcggtggtttttttgtttgcacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5046 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaccccacatatcagatgaagaagcaaacctcttcgccatgcaattagcaagtgctttagttcttcccatgactttaaaataacatcttgaacttgatctcttagaaatcattgctaaagctggacctcgtgctcaaatttcacctattgaaattgcttctcagctctcaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5047 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcatatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5048 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcatatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5049 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcatatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5050 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5051 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5052 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5053 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5054 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5055 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagaaggaaaggttcagagactttagggtttggctactgtcactaa

SEQ ID NO: 5056 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5057 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcacacctcttcaccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5058 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5059 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5060 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5061 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcccttggcttgttacaatatcctcacttgttcagttcgtactcaacaagatggaaaggttcagagactttatggtttggctactgttgctaa

SEQ ID NO: 5062 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5063 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5064 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5065 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaattagcaagtgcttcagttcttcccatgattttaaaatcagctcttgaacttgatctcttagaaatcattgctaaagctggacctagtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5066 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatctttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5067 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5068 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5069 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5070 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5071 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgagtgttgcgtctcttggcttgttacaatatcctcacttgttcagttcgtactcaacaagatggaaagattcagagactttatggtttggctactgttgctaa

SEQ ID NO: 5072 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5073 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5074 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5075 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5076 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgctgctaa

SEQ ID NO: 5077 - DNA, 362 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 5078 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacgatatcctcacttgttcagttcgtactcaacaagatggaaaggttcagagactttatggtttggctactgttgctaa

SEQ ID NO: 5079 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5080 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5081 - DNA, 363 bp, Artificial
  MsCOMT deletion introduced by TALEN pair MsCOMT_T01.1
tctcacaaaaacctcatcaatcacaaccatgggttcaacaggtgaaactcaaataaccacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5082 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaccacacatatcacaggaagaagcacacatcttcgccacgcaccaagcaaaagctttagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5083 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccgtgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5084 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5085 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5086 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5087 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcacctgttatgttggaccgaatgttgcgtctcttggcttgttacaatatcctcacttgttcagttcgtactcaacaagatggaaaggttcagagactttatggtttggctactgttgctaa

SEQ ID NO: 5088 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5089 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5090 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagtaatcattgctaaagctggacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5091 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5092 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttagggtttggctactgttgctaa

SEQ ID NO: 5093 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5094 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5095 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgttgcaccagttatgttggaccgaatgttgcgtctcttggcttgttacaatatcctcacttgttcagttcgtactcaacaagatggaaaggttcagagactttatggtttggctactgttgctaa

SEQ ID NO: 5096 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5097 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5098 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5099 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5100 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5101 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5102 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5103 - DNA, 360 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttatcagcttccaacaactaaccctgatgcaccagttatgtttgaccgaattttgcgtctcttggcttggtacaatatcctcactttttcagttcgtactcaacaagatggaaaaattcagagactttatgggttggctactgttgctaac

SEQ ID NO: 5104 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5105 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaattagcaagtgcttcagttcttcccatgattttaaaataagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5106 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcatttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5107 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5108 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5109 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5110 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5111 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 5112 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagagggaaagattcagagcctttatggtttggctactgttgctaa

SEQ ID NO: 5113 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5114 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5115 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5116 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaaagttcagagactttatggtttggctactgttgctaa

SEQ ID NO: 5117 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5118 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 5119 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggggctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5120 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagcacttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5121 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5122 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5123 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5124 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5125 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttcccatgatttcgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5126 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctcttcgccatgcaactagcaagtgcttcagttcttaccatgattttaaaatcagctcttgaacttgatctcttagaaatcattgctaaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5127 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcagatgaagaagcaaacctattcgccatgtaactagcaagtgcttcaattcttcccattattttaaaatcagctcttgaacttgatctcttagaaatcattgctaaagctggacctgttgctcaaatttcccctattgaaattgcttatcagctaccaactactaaccctgatgcaccagttacgttggaccgaatgttgcgtctcttggcttgttacaatttcctcacttgttcagttcgtactcaacaagattgaaaagttcagagactttatggtttagctactgttgctaa

SEQ ID NO: 5128 - DNA, 359 bp, Artificial
  MsCOMT deletion introduced by TALEN pair MsCOMT_T01.1
tctcacaaaaacctcatcaatcacaaccatgggttcaacaggtgaaactcaaataaccacatatcacatgtagaatcaaacctcaacgccatgcaattagcaagtacttcagttcttaccttgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5129 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccccatatcagatgaagaagcccaactcttcgccatgcacctagcacatgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5130 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccccatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcta

SEQ ID NO: 5131 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5132 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5133 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccatatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5134 - DNA, 362 bp, Artificial
  MsCOMT deletion introduced by TALEN pair MsCOMT_T01.1
tctcacaaaaacctcatcaatcacaaccatgggttcaacaggtgaaactcaaataaccaacccacatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5135 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgtagaagcaaacctcttcgccatacaacaatcaaaagcgtcagttctccccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5136 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatggagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5137 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatggagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5138 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagtagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5139 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaaggagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5140 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagcagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaacagttatgttggaccgaatgttgcgtctcttggcttgttacaatatcctcacttgttcagttcatactcaacaagatggaaagattcagagactttatggttttgctactgttgctaa

SEQ ID NO: 5141 - DNA, 361 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5142 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcgaacctcttcgccatgcaactagcaagtgcttcagttcttcccatgattttaaaatcagctcttgaacttgatctcttagaaatcattgctaaagctggaccttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5143 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5144 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtagctaa

SEQ ID NO: 5145 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5146 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5147 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5148 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5149 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5150 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5151 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 5152 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5153 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5154 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaacgttgcgtctcttggcttgttacaatatcctcacttgttcagttcgtactcaacaagatggaaaagttcagagactttatggtttggctactgttgctaa

SEQ ID NO: 5155 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgctggaccgaatgttgcgtctcttggcttgttacaatatcctcacttgttcagttcgtactcaacaagatggaaaggttcagagactttatggtttggctactgttgctaa

SEQ ID NO: 5156 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5157 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaagattcagagactttatggtttggctactgttgctaa

SEQ ID NO: 5158 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5159 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5160 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5161 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5162 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5163 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccattcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5164 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagctagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5165 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5166 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 5167 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagatgcagagactttatggtttggctactgttgctaa

SEQ ID NO: 5168 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5169 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 5170 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5171 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttagctactgttgctaa

SEQ ID NO: 5172 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5173 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5174 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5175 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5176 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgctctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 5177 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctgttgctcaaatttcacctgttcaaattgcttctcagctcccaacaactaaccctgatgcaccagttatgttgaaccgaatgtcgcgtctcttggcttgttacaatttcctcacttgttcagttcgtactcaacaagatggaaagattcagagactttatggtttggctactgttgctaa

SEQ ID NO: 5178 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5179 - DNA, 360 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcctgttggaccgaatgttgcgtctcttggcttgttacaatagcctcacttgttcagttcgtactcaacaagatggaaagattcagagactttatggtttggctactgttg

SEQ ID NO: 5180 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5181 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttgctactgttgctaa

SEQ ID NO: 5182 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5183 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5184 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5185 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctccgctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5186 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 5187 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 5188 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5189 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5190 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctgacttgttcagttcgtactcaacaagatggaaagattcagagactttatggtttggctactattgctaa

SEQ ID NO: 5191 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 5192 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 5193 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5194 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5195 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaac

SEQ ID NO: 5196 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5197 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaatattcagagactttatggtttggctactgttgctaa

SEQ ID NO: 5198 - DNA, 354 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcta

SEQ ID NO: 5199 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaaagttcagagactttatggtttggctactgttgctaa

SEQ ID NO: 5200 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 5201 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttctgttcgtactcaacaagatggaaaggttcagagactttatggtttggctactgttgctaa

SEQ ID NO: 5202 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5203 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5204 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5205 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 5206 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5207 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5208 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgatctcttagaaatcattgccaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5209 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcagttcttcccatgattttaaaatcagctcttgaacttgacctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5210 - DNA, 362 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtgcttcaattcttcccatgattttaaaatcagctcttgaacttgatctcttaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5211 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaattagcaagtccttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5212 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgtttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5213 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaagtcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5214 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttggtctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5215 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaattcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5216 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5217 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5218 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5219 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5220 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5221 - DNA, 365 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggttgctaa

SEQ ID NO: 5222 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5223 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5224 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 5225 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaataactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5226 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5227 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 5228 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5229 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5230 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5231 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagcctttatggtttggctactgttgctaa

SEQ ID NO: 5232 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 5233 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5234 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcacttcgtactcaacaagatggaaaagttcagagactttatggtttggctactgttgctaa

SEQ ID NO: 5235 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctcggcttgttacaatatcctcacttgttcagttcgtactcaacaagatggaaagattcagagactttatggtttggctactgttgctaa

SEQ ID NO: 5236 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5237 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctctcagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5238 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5239 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5240 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5241 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5242 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5243 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5244 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaagattcagagactttatggtttggctactgttgctaa

SEQ ID NO: 5245 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctactaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5246 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggcttggctactgttgctaa

SEQ ID NO: 5247 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5248 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5249 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5250 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatgcaactagcaagtgcttcagttcttcccatgatttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5251 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatccaattagcaagtgcttcagttcttcccatgattttaaaatcagctcttgaacttgatctcttagaaatcattgctaaagctggaccttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5252 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccatccaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5253 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcgccacgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5254 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcttcaccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5255 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaacctcctcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5256 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagccaaccacttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5257 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5258 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcacacctcttcgccatgcaattagcaaatgcttcagttcttcccattattttaaaatcagctcttgaacttgatctcttagaaatcattgctaaacctggccctagttctcaaatgtcacctattgaaatttcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5259 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcacacctcttcgccatgcaattagcaaatgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5260 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5261 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5262 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaagctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5263 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatttaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5264 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5265 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5266 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5267 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5268 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5269 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5270 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctacgttgctaa

SEQ ID NO: 5271 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagcctttatggtttggctactgttgctaa

SEQ ID NO: 5272 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5273 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5274 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5275 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 5276 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5277 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5278 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5279 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 5280 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5281 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcgtggcttgttacaatatcctcacttgttcagttcgtactcaacaagatggaaagattcagagactttatggtttggctactgttgctaa

SEQ ID NO: 5282 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaattagcaagtacttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5283 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagcttgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5284 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5285 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5286 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5287 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 5288 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 5289 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5290 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5291 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5292 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5293 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5294 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgaaaggttcagagactttatggtttggctactgttgctaa

SEQ ID NO: 5295 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 5296 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaacaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5297 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtcctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5298 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5299 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5300 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5301 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgccattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5302 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcatttagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5303 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcatctagcaagtgcttcagttcttcccatgattttgaaatcagctcttgaacttgatctcttagaaatcattgctaaagctggacctggcgctcaaatttcacctattgaaattgcttctcagctaccaacaactaaccctgatgcaccagttatgttggaccgaatgttgcgtctcttggcttgttacaatatcctcacttgtccagttcgtactcaacaagatggaaaggttcagagactttatggtttggctactgttgctaa

SEQ ID NO: 5304 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5305 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcacttagcaagtgcttcagttcttcccatgattttaaaatcagctcttgaacttgatctcttagaaatcattgctaaagctggacctggtgctcaaatctcacctattgaaattgcttctcagctcccaacaactaaccctgatgcaccagttatgttggaccgaatgttgcgtctctgggcttgttacaatatcctcacttgttcagttcgtactcaacaagatggaaagattcagagactttatggtttggctactgttgctaa

SEQ ID NO: 5306 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttaagttcgtactcaacaagatggaaaagttgagagactttatggtttggctactgttgctaa

SEQ ID NO: 5307 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagctagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5308 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagctagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5309 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 5310 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgcttttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5311 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5312 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgattcaccagttatgttggaccgaatgttgcgtctcttggcttgttacaatatcctcacttgttctgttcgtactcaacaagatggaaaggttcagagcctttatggtttggctactgttgctaa

SEQ ID NO: 5313 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5314 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5315 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5316 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactttgctaa

SEQ ID NO: 5317 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 5318 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatggaaagattcagagactttatggtttggctactgttgctaa

SEQ ID NO: 5319 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgtatgttgcgtctcttggcttgttacaatatcctcacttgttcagttcgtactcaacaagatggaaagattcagagactttatggtttggctactgttgctaa

SEQ ID NO: 5320 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcagcaagatggaaagattcagagactttatggtttggctactgttgctaa

SEQ ID NO: 5321 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagctatgttggaccgaatgttgcgtctcttggcttgttacaatatcctcacttgttcagttcgtactcaacaagatggaaaggttcagagactttatggtttggctactgttgctaa

SEQ ID NO: 5322 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5323 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5324 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5325 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5326 - DNA, 356 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctact

SEQ ID NO: 5327 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 5328 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggtccgaatgttgcgtctcttggcttgttacaatatcctcacttgttcagttcgtactcaacaagatggaaagattcagagactttatggtttgtctactgttgctaa

SEQ ID NO: 5329 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5330 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5331 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctgatgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5332 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagctcttaaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5333 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttgaaatcagcccttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5334 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctgttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5335 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagtaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgctcgtactcaacaagatggaaaggttcagagactttatggtttggctactgttgctaa

SEQ ID NO: 5336 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5337 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaatctggaccttgtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttcgctactgttgctaa

SEQ ID NO: 5338 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaatctggacctggtgctcaaatttcacctattgaaattgcttctcagctcccaacaactaaccctgatgcaccagttatgttggaccgaatgttgcgtctctttgcttgttacaatatcctcacttgttcagttcgtactcaacaagatggaaaggttcagagactttatggtttggctactgttgctaa

SEQ ID NO: 5339 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctaccaacaactaaccctgatgcaccagttatgttagaccgaatgttgcgtctcttggcttgttacaatatcctcacttgttctgttcgtactcaacaaggtggaaaggttcagagactttatggtttggctactgttgctaa

SEQ ID NO: 5340 - DNA, 365 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggatctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaac

SEQ ID NO: 5341 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5342 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5343 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5344 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 5345 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5346 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagcctttatggtttggctactgttgctaa

SEQ ID NO: 5347 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5348 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5349 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttgacttgttacaatatcctcacttgttctgttcgtactcaacaagatggaaaggttcagagactttatggtttggctactgttgctaa

SEQ ID NO: 5350 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 5351 - DNA, 364 bp, Artificial
  MsCOMT deletion introduced by TALEN pair MsCOMT_T01.1
  misc_feature (364): n is a or c or t or g
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctan

SEQ ID NO: 5352 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5353 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5354 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5355 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5356 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5357 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5358 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcatctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5359 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5360 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5361 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 5362 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggtccgaatgttgcgtctcttggcttgttacaatatcctcacttgttcagttcgtactcaacaagatggaaaggttcagagactttatggtttggctactgttgctaa

SEQ ID NO: 5363 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5364 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5365 - DNA, 354 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacccttatgcaccagttatgtaggatcgaatgttacataacatggcgtgttactatatcctcgtttgttcggatcgtactcgtcaggatggaaagattgagagagttaagggtaggggaa

SEQ ID NO: 5366 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaagattcagagactttatggtttggctactgttgctaa

SEQ ID NO: 5367 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttccgttggaccgaatgttgcgtctcttggcttgttacaatatcctcacttgttcagttcgtactcaacaagatggaaagattcagagactttatggtttggccactgttgctaa

SEQ ID NO: 5368 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5369 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 5370 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5371 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5372 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5373 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5374 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttactaa

SEQ ID NO: 5375 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgggttggctactgttgctaa

SEQ ID NO: 5376 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtagcgtcacttggcttgttacaatatcctcacttgttcagttcgtactcaacaagatggaaaggttcagagactttatggtttggctactggtgctaa

SEQ ID NO: 5377 - DNA, 365 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaac

SEQ ID NO: 5378 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggactgaatgttgcgtctcttggcttgttacaatatcctcacttgttcagttcgtactcaacaagatggaaagattcagagactttatggtttggctactgttgctaa

SEQ ID NO: 5379 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 5380 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 5381 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 5382 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgaaaagattcagagactttatggtttggctactgttgctaa

SEQ ID NO: 5383 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 5384 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttagggtttggctactgttgctaa

SEQ ID NO: 5385 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 5386 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttctgttcgtactcaacaagatggaaaggttcagagactttatggtttggctactgttgctaa

SEQ ID NO: 5387 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaagattcagagactttatggtttggctactgttgctaa

SEQ ID NO: 5388 - DNA, 365 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacttgttgctaa

SEQ ID NO: 5389 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgttctcaacaagatggaaagattcagagactttatggtttggctactgttgctaa

SEQ ID NO: 5390 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattaagagactttatggtttggctactgttgctaa

SEQ ID NO: 5391 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgtatgttgcgtctcttggcttgttacaatatcctcacttgttctgttcgtactcaacaagatggaaaggttcagagactttatggtttggctactgttgctaa

SEQ ID NO: 5392 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatgggttggctactgttgctaa

SEQ ID NO: 5393 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 5394 - DNA, 354 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcta

SEQ ID NO: 5395 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctctttgcttgttacaatatcctcacttgttcagttcgtactcaacaagatggaaagattcagagactttatggtttggctactgttgctaa

SEQ ID NO: 5396 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 5397 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 5398 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttggtacaatatcctcacttgttcagttcgtactcaacaagctggaaaggttcagagactttatggtttggctactgttgcta

SEQ ID NO: 5399 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 5400 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 5401 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5402 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5403 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 5404 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5405 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagatatgttggaccgaatgttgcgtctcttggcttgttacaatatcctcacttgttcagttcgtactcaacaagatggaaagattcagagactttatggtttggctactgttgctaa

SEQ ID NO: 5406 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5407 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5408 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5409 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgtcggaccgaatgttgcgtctcttggcttgttacaatatcctcacttgttcagttcgtactcaacaagatggaaagattcagagactttatggtttggctactgttgctaa

SEQ ID NO: 5410 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5411 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgagtctcttggcttgttacaatatcctcacttgttcagttcgtactcaacaagatggaaaggttcagagactttatggtttggctactgttgctaa

SEQ ID NO: 5412 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 5413 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 5414 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 5415 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgtggcgtctcttggcttgttacaatatcctcacttgttcagttcgtacttaacaagatggaaaggttcagagactttttggtcaggatacagttgctaa

SEQ ID NO: 5416 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggcactgttgctaa

SEQ ID NO: 5417 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5418 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 5419 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 5420 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 5421 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 5422 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatattggaccgaatgttgcgtctcttggcttgttacaatatcctcacttgttcagttcgtactcaacaagatggaaaggttcagagactttatggtttggctactgttgctaa

SEQ ID NO: 5423 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttaagttggaccgaatgttgcgtctcttggcttgttacaatatcctcacttgttcagttcgtactcaacaagatggaaaggttcagagactttatggtttggctactgttgctaa

SEQ ID NO: 5424 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5425 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5426 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcccagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5427 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcacagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5428 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcacagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5429 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccaattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5430 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaactattgaaattgcttctcagctcccaacaactaaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 5431 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5432 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5433 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5434 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5435 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctgatgctcaaatttcacctattgaaattgcttctcagctcccaacaactaaccctgatgcaccagttatgttggaccgaatgttacgtctattggcttgttacaatatcctcacttgttcagttcgtactcaacaagatggaatggttcagagactttatggtttgcctactgtttctaa

SEQ ID NO: 5436 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcactgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5437 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaactagatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 5438 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5439 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5440 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttcttcccatgatattaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaagattcagagactttatggtttggctactgttgctaa

SEQ ID NO: 5441 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttctccccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5442 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttcagttctacccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5443 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcttaagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5444 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5445 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagtgattcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5446 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaaggttcagagcctttatggtttggctactgttgctaa

SEQ ID NO: 5447 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagggcttcagttcttccaatgattttaaaatcagctcttgaacttgatctcttagaaatcattgctaaagctggacatggtgctcaaatttcacctcttgaaatttcttctcagctaccaacaactaaccctgatgcaccagttttgttggaccgattgttgcgtctcttggcttgttacaatatgctctcttgttctgttcgtactcaacaagatggaaaagttcagagactttatggtttggctactgatgctaa

SEQ ID NO: 5448 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagcgcttcagttcttcccatgattttaaaatcagctcttgaacttgatctcttagaaatcattgctatagctggacctggtgctcaaatttcacctattgaaattgcttctcagctaccaacaactaaccctgatgcaccagttatgttggacccaatgttgcgtcgcttggcatgttacaatatcctcaattgttcagttcgtactcagcaagatggaaaagttcagagactttatggtttggctactgtggctaa

SEQ ID NO: 5449 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5450 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaaatgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5451 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaattagcaaatgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 5452 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcatgtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5453 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtggttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5454 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttggaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5455 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcatctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5456 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcgttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5457 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5458 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5459 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5460 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5461 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5462 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatttaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5463 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgagattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5464 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaacttgcttctcagctaccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 5465 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatttcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5466 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5467 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5468 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5469 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5470 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5471 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcactagttatgttggaccgaatgttgcgtctcttggcttgttacaatatcctcacttgttcagttcgtactcaacaagatggaaaggttcagagactttatggtttggctactgttgctaa

SEQ ID NO: 5472 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5473 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5474 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctgctgttgctaa

SEQ ID NO: 5475 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5476 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgtaccgaatgttgcgtctctttgcttgttacaatatcctcacttgttcagttcgtactcaacaagatggaaaggttcagagactttatggtttggctactgttgctaa

SEQ ID NO: 5477 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5478 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 5479 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5480 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 5481 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 5482 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 5483 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttaagttcgtactcaacaagatggaaagattcagagactttatggtttggctactgttgctaa

SEQ ID NO: 5484 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 5485 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 5486 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 5487 - DNA, 365 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggttttggctactgttgctaa

SEQ ID NO: 5488 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactattgctaa

SEQ ID NO: 5489 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttgctactgttgctaa

SEQ ID NO: 5490 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 5491 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5492 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagcctgatgcacaagttatgttggaccgaatgttgcgtctcttggcttgttacaatatcctcacttgttcagttcgtactcaacaagatggaaaggttcagagactttatggtttggctactgtggctaa

SEQ ID NO: 5493 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttttttggaaccgatgtttgcgtctcttggctgtttacaatatcctccctgttcagttcgtactcaacaagatggaaaagttcagagactttatggtttggctactgttgctaa

SEQ ID NO: 5494 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcggctcttggcttgttacaatatcctcacttgttcagttcgtactcaacaagatggaaaggttcagagactttatggtttggctactgttgctaa

SEQ ID NO: 5495 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5496 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5497 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 5498 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5499 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaagattcagagactttatggtttggctactgttgctaa

SEQ ID NO: 5500 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtggcgtctcttggcttgttacaatatcctcacttgttcagttcgttctcaacaagatggaaaggttcagagactttatggtttggctactgttgctaa

SEQ ID NO: 5501 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagcctttatggtttggctactgttgctaa

SEQ ID NO: 5502 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 5503 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 5504 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttagcttgtaacaatatcctcacttgttcagttcgtactcaacaagatggaaaggttcagagactttatggtttggctactgtgctaa

SEQ ID NO: 5505 - DNA, 365 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaaa

SEQ ID NO: 5506 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5507 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcaattcgtactcaacaagatggaaagattcagagactttatggtttggctactgttgctaa

SEQ ID NO: 5508 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 5509 - DNA, 360 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggcgttgctaa

SEQ ID NO: 5510 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 5511 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcaggtcgtactcaacaagatggaaaagttcagagactttatggtttggctactgttgctaa

SEQ ID NO: 5512 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5513 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctaccgttgctaa

SEQ ID NO: 5514 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 5515 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 5516 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttacgttggaccgaatgttgcgtctcttggcttgttacaatatcctcacttgttcagttcgtactcaacaagatggaaaggttcagagactttatggtttggctactgttgctaa

SEQ ID NO: 5517 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5518 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5519 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 5520 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5521 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcacctcccaccaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 5522 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgctcctcagctcccaacaactaaccctgatgcaccagttatgttgggccgaatgttgcgtctcttggcgtgttacaatatcctcacttgttcagttcgtactcaacaagatggaaaggttcagagactttatggtttggctactgttgctaa

SEQ ID NO: 5523 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattccttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5524 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5525 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5526 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctagtggtcaaatttcacctattgaaattgcttctcagctaccaacaactaaccctgatgcaccagttatgttggaccggatgttgcgtctcttggcttgttacaaattcctctcttgttcagttcgtactcaacaagatggaaaggatcagagactttattgtttggctactggtgctaa

SEQ ID NO: 5527 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5528 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacatagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5529 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5530 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5531 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcctagaaatcattgctaaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaagattcagagactttatggtttggctactgttgctaa

SEQ ID NO: 5532 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcatagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagacttatggtttggctactgttgctaa

SEQ ID NO: 5533 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatcccttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5534 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacatgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5535 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggaccttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5536 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5537 - DNA, 363 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcattttggaccgattgttgcgcctcttggctttttacaatatcctcacttgttcagttcgtactcaacaagaggaaaaggttcagacactttatggtttggtactgttgctaa

SEQ ID NO: 5538 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5539 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 5540 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5541 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggatcgaatgttgcgtctcttggcttgttacaatatcctcacttgttcagttcgtactcaacaagatggaaagattcagagactttatggtttggctactgttgctaa

SEQ ID NO: 5542 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5543 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5544 - DNA, 365 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcttaa

SEQ ID NO: 5545 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5546 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5547 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5548 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5549 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggtttgttacaatatcctcacttgttcagttcgtactcaacaagatggaaagattcagagactttatggtttggctactgttgctaa

SEQ ID NO: 5550 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 5551 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5552 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgactctttgcttgttacaatatcctcacttgttcagttcgtactcaacaagatggaaaggttcagagactttatggtttggctactgttgctaa

SEQ ID NO: 5553 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5554 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttattttggaccgaatgttgcgtctcttggcttgttacaatatcctcacttgttcatttcgtactcaacaagattgaaaggttcagagactttatggtttggctactgttgctaa

SEQ ID NO: 5555 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5556 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5557 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5558 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5559 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5560 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5561 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 5562 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatatcttagaaatcatttctaaagctggacctaatgctcaaatttcacctattgaaattgcttctcagctcccaacaactaaccctgatgcaccagttatattaaaccgaatttttcgtctctttgcttattacaatatcctcactttttcatttcttactcaacaatattcaaatattcagagactttatgctttatctactgttcctaa

SEQ ID NO: 5563 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaactcgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5564 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcctgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5565 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccatgatattaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaataagatggaaaggttcagagactttatggtttggctactgttgctaa

SEQ ID NO: 5566 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcttcccaagattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5567 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcttcagttcgtcccatgattttgaaatcagctcttgcacttgatctcttagaaatcattgctaaagctggacctggtgctcaaatttcacctattgaaattgcttctcagctaccaacaacgaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 5568 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgctccagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5569 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaagtgcctcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5570 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaaatgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5571 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactagcaaatgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5572 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5573 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatgaaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5574 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatccaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5575 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatccaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5576 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatccaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagtctttatggtttggatactgttgctaa

SEQ ID NO: 5577 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatccaactagcaagtgcttcagttcttcccatgattttaaaatcagctcttgaacttgatctcttagaaatcattgctaaagctggacctggtgctcaaatttcacctattgaaattggttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5578 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5579 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatacaattagcaagagcttcagttcttcccatgattttaaaatcagctcttgaacttgatctcttagaaatcattgctaaagctggacctggtgctcaaatttcacctgttcaaattgcttctcagcttccatcaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 5580 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatacaactatcaaatgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5581 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5582 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatacaactagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5583 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcgccatacaactagcaagagcttcagttcttcccatgattttgaaatcacctcttgaactctagctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5584 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5585 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctctccgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5586 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctctccgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5587 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacctctccgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 5588 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacatcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5589 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacatcttcgccatgcaattagcaaatgcttcagttcttcccatgattttaaaatcagctcttgaacttgatctcttagaaatcattgctaaagctggaccttgtgctcaaatttcacctattgaaattgcttctcagctctcaacaactaaccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 5590 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaacatcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5591 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaagcaaaactcttcgccatgcaattagcaagtgcttcagttcttcccatgattttaaaatcagctcttgaacttgatctcttagaaattattgctaaagctggacctggtgctcatatttcacctgttcaaattgcttctcagcttccaacaactaaccctgatgcaccagtcttgttgggccgaatgtggcgtctcttggcttgttgcagtgtcctctcttgttctgttcgtactcaacaggatggaaaggttcagagtctttatggtctggcgactggtgctag

SEQ ID NO: 5592 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaaacaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5593 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagatgaagaaacaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5594 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagataaagaagcaaacctcttcgccatgcaattagcaagtgcttcagttcttcccatgattttgaaatcagctcttgaacatgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5595 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagataaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5596 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagataaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5597 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagataaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5598 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagataaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5599 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagataaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5600 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagataaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5601 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagacgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5602 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcagacgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5603 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacatatcacatgaagaagccaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5604 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacacatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5605 - DNA, 364 bp, Artificial
  MsCOMT deletion introduced by TALEN pair MsCOMT_T01.1
tctcacaaaaacctcatcaatcacaaccatgggttcaacaggtgaaactcaaataaccaacccacacatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5606 - DNA, 360 bp, Artificial
  MsCOMT deletion introduced by TALEN pair MsCOMT_T01.1
tctcacaaaaacctcatcaatcacaaccatgggttcaacaggtgaaactcaaataaccaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttagaccgaatgttgcgtctcttggcttgttacaatatcctcacttgttcagttcgtactcaacaagatggaaaggttcagagactttatggtttggctactgttgctaa

SEQ ID NO: 5607 - DNA, 360 bp, Artificial
  MsCOMT deletion introduced by TALEN pair MsCOMT_T01.1
tctcacaaaaacctcatcaatcacaaccatgggttcaacaggtgaaactcaaataaccaacatatcagatgaagaagcaaacctcttcgccatgaaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggacccaatttttcgtctcttggcttgttacaatttcctcacttgttcagttcgtactcaacaagatggaaaggttcagagactttattgtttggctactgttgctaa

SEQ ID NO: 5608 - DNA, 446 bp, Artificial
  MsCOMT deletion introduced by TALEN pair MsCOMT_T01.1
tctcacaaaaacctcatcaatcacaaccatgggttcaacaggtgaaactcaaataacatttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5609 - DNA, 446 bp, Artificial
  MsCOMT deletion introduced by TALEN pair MsCOMT_T01.1
tctcacaaaaacctcatcaatcacaaccatgggttcaacaggtgaaactcaaataacatttggtgatgtggttcagcctggtcagctgggccttgtagttgcccttgaagtggccggacacgaacaggaacctgaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5610 - DNA, 396 bp, Artificial
  MsCOMT deletion introduced by TALEN pair MsCOMT_T01.1
tctcacaaaaacctcatcaatcacaaccatgggttcaacaggtgaaactcaaataacatcaccggcaacagcgcctgcaccgtctccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5611 - DNA, 396 bp, Artificial
  MsCOMT deletion introduced by TALEN pair MsCOMT_T01.1
tctcacaaaaacctcatcaatcacaaccatgggttcaacaggtgaaactcaaataacatcaccggcaacagcgcctgcaccgtctccaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5612 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5613 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5614 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5615 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5616 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5617 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagctagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5618 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5619 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5620 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5621 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5622 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5623 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 5624 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcacgagttatgttggaccgaatgttgcgtctcttggcttgttacaatatcctcacttgttcagttcgtactcaacaagatggaaaggttcagagactttatggtttggctactgttgctaa

SEQ ID NO: 5625 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5626 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5627 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5628 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5629 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttaaaatcagctcttgaacttgatctcttagaaatcattgctaaagctggacctggtgctcaaattttacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5630 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggctcagagactttatggtttggctactgttgctaa

SEQ ID NO: 5631 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5632 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5633 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5634 - DNA, 356 bp, Artificial
  MsCOMT deletion introduced by TALEN pair MsCOMT_T01.1
tctcacaaaaacctcatcaatcacaaccatgggttcaacaggtgaaactcaaataacatatcaaatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactgtatggtttggctactgttgctaa

SEQ ID NO: 5635 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttgttgatgtggttcagcctggtcagctgggccttgtatttgcccttgaagtggccggacacgaacaggaacttgaacaccaacccacatatcagatgacgaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5636 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagtctggtcagctgggccttgtagttgcccttgaagtggccggacacgaacaggaacttgaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5637 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggtcttgtagttgcccttgaagttgccggacacgaacaggaacttgaacaccaacccacatatcagatgaagaagcaaacctcttcgccatgcaattagcaagtgcttcagttcttcccatgattctaaaatcaactcttgaacttgatctcttagaaatcattgctaaagctggacctggtgctcaaatttcacctattgaaattgcttctcagctaccaacaactaaccctgatgcaacagttatgttggaccgaatgttgcgtcacttggcttgttacaatatcctcacttgttcagttcgtactcaacaagatggaaaggttcagagactttatggtttggctactgttgctaa

SEQ ID NO: 5638 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtatttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5639 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtatttgcccttgaagtggccggacacgaacaggaacttgaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5640 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggcacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaagattcagagactttatggtttggctactgttgctaa

SEQ ID NO: 5641 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5642 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5643 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5644 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5645 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctacagctggacctggtgctcaaatttcacctattgaaaatacttctcagctcccaacaactaaccctgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 5646 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5647 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5648 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 5649 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5650 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5651 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5652 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggataggttcagagactttatggtttggctactgttgctaa

SEQ ID NO: 5653 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaaactcttcgccatgcaactagcaagtgcttcagttcttcccatgattttaaaatcagctcttgaacttgatctcttagaaatcattgctaaagctggacctggtgctcaaatttcacctattgaaatagcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5654 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggccttgtagttgcccttgaagtgaccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 5655 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgatgtggttcagcctggtcagctgggcattgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5656 - DNA, 446 bp, Artificial
  MsCOMT deletion introduced by TALEN pair MsCOMT_T01.1
tctcacaaaaacctcatcaatcacaaccatgggttcaacaggtgaaactcaaataacagttggtgacgtggttcagcctggtcagctgggccttgtagttgcccttgaagtggccggacacgaacaggaacttgaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5657 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcacctgcaacagcgcctgcaccgtctccaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5658 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5659 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5660 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5661 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5662 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatgtcacctattgacattgcttcaaatctactaacagctacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5663 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5664 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5665 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5666 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactctacaagatggaaagattcagagactttatggtttggctactgttgctaa

SEQ ID NO: 5667 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5668 - DNA, 396 bp, Artificial
  MsCOMT deletion introduced by TALEN pair MsCOMT_T01.1
tctcacaaaaacctcatcaatcacaaccatgggttcaacaggtgaaactcaaataacagcaccggcaacagcgcctgcaccgtctccaccaacccacatatcagaggaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5669 - DNA, 357 bp, Artificial
  MsCOMT deletion introduced by TALEN pair MsCOMT_T01.1
tctcacaaaaacctcatcaatcacaaccatgggttcaacaggtgaaactcaaataacactatcagatgaagcagcaaaactattagccctgcaactcacaaatgcatcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5670 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttcagccaacacccggcagcgttagggaccgtcgctgtcaagtatcaggacatgatcgcagcgttgccagaggcgacacacgaagccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5671 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttcagccaacacccggcagcgttagggaccgtcgctgtcaagtatcaggacatgatcgcagcgttgccagaggcgacacacgaagccaacccacatatcagatgaagaagcaaacctcttcgccatgcaattagcaagtgcttcagttcttcccatgattttaaaagccgctgttgaacttgatatcttagaaatcattgcgaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5672 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagtgaccgtcgctgtcaagtatcaggacatgatcgcagcgttgccagaggcgacacacgaagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5673 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgcagaagcaaacctcttcgccatgcaattagcacgtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5674 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaattagctagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5675 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaattagcaagtgcttcagttcttcccattattttaaaagcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5676 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgctccagttatgttggaccgaatgttgcgtctcttggcttgttacaatatcctcacttgttcagttcgtactcaacaagatggaaagattcagagactttatggtttggctactgttgctaa

SEQ ID NO: 5677 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 5678 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5679 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaattagcaagtgcttcagttcttcccatgattttaaaatcagctcttgtacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5680 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaactagcacgtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5681 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5682 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5683 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5684 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacgaagccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5685 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcgttaagccaacacccggcagcgttagggaccgtcgctgtcaagtatcaggacatgatcgcagcgttgccagaggcgacacacaaagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5686 - DNA, 479 bp, Artificial
  MsCOMT deletion introduced by TALEN pair MsCOMT_T01.1
tctcacaaaaacctcatcaatcacaaccatgggttcaacaggtgaaactcaaataacacgggtttacacacgcgcacatcgttgcattaagccaacacccggcagcgttagggaccgtcgctgtcaagtatcaggacatgatcgcagcgttgccagaggcgacacacgaagccaacccacatatcagatgaagaagcaaacctcttcgccatgcaattagcaagtgcttcagttcttcccatgattttaaaatcagctcttgaacttgatctcttagaaatcattgctaaagctggacctggtgctcaaagtgcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5687 - DNA, 363 bp, Artificial
  MsCOMT deletion introduced by TALEN pair MsCOMT_T01.1
tctcacaaaaacctcatcaatcacaaccatgggttcaacaggtgaaactcaaataacaccccacatatcagatgatgaagcaacactcttcgccatgaaattagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5688 - DNA, 366 bp, Artificial
  MsCOMT deletion introduced by TALEN pair MsCOMT_T01.1
tctcacaaaaacctcatcaatcacaaccatgggttcaacaggtgaaactcaaataacaccccacaacatatcagatgaagcagaaaacctcttcacgctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5689 - DNA, 360 bp, Artificial
  MsCOMT deletion introduced by TALEN pair MsCOMT_T01.1
tctcacaaaaacctcatcaatcacaaccatgggttcaacaggtgaaactcaaataacacccatatcagatgaagatgaaaaactaatcgccatgcaactagcaagagcttcagttcttcccatgattttaaaatcagctcttgaacttgatctcttagaaatcattgctaaagctgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5690 - DNA, 360 bp, Artificial
  MsCOMT deletion introduced by TALEN pair MsCOMT_T01.1
tctcacaaaaacctcatcaatcacaaccatgggttcaacaggtgaaactcaaataacacccataccagtttaagaagcaaacctcaacgccatgcaactaccaagagcaacagctcctcccatgactttaaaatcagatcttgaacttgatctcttacaaatcatagctatagctgaacctggtgctcaaacttaacctactgatattgaatctcatctcccaccaccaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5691 - DNA, 420 bp, Artificial
  MsCOMT deletion introduced by TALEN pair MsCOMT_T01.1
tctcacaaaaacctcatcaatcacaaccatgggttcaacaggtgaaactcaaataacaccagctcagccaggcccacagcttgcacccggcgcaggcgtgggacaaccaaagccaacccacataccaattgaagaaaaaacccccctcgacattcaactagcaaaagcttcagttctacccatgattttgaaatcagctcttgaacttgatctcttagaaatcattgctaaagctggacctggtgctcaaatttcacctattcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5692 - DNA, 390 bp, Artificial
  MsCOMT deletion introduced by TALEN pair MsCOMT_T01.1
tctcacaaaaacctcatcaatcacaaccatgggttcaacaggtgaaactcaaataacaccacctgctccggggtcaagccgtggtgctgacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5693 - DNA, 390 bp, Artificial
  MsCOMT deletion introduced by TALEN pair MsCOMT_T01.1
tctcacaaaaacctcatcaatcacaaccatgggttcaacaggtgaaactcaaataacaccacctgctccggggtcaagccgtggtgctgacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcatctcccaacaactaaccctgatgcaccagtgatgttggaccgaatgttgcgtctcttggctggtgacaatatcctcacttgttcagttcgtactcagcaagatggaaagattcagagactttatgggttggctactgttgctaa

SEQ ID NO: 5694 - DNA, 390 bp, Artificial
  MsCOMT deletion introduced by TALEN pair MsCOMT_T01.1
tctcacaaaaacctcatcaatcacaaccatgggttcaacaggtgaaactcaaataacaccacctgctccggggtcaagccgtggtgctgacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5695 - DNA, 390 bp, Artificial
  MsCOMT deletion introduced by TALEN pair MsCOMT_T01.1
tctcacaaaaacctcatcaatcacaaccatgggttcaacaggtgaaactcaaataacaccacctgctccggggtcaagccgtggtgctgacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5696 - DNA, 390 bp, Artificial
  MsCOMT deletion introduced by TALEN pair MsCOMT_T01.1
tctcacaaaaacctcatcaatcacaaccatgggttcaacaggtgaaactcaaataacaccacctgctccggggtcaagccgtggtgctgacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 5697 - DNA, 390 bp, Artificial
  MsCOMT deletion introduced by TALEN pair MsCOMT_T01.1
tctcacaaaaacctcatcaatcacaaccatgggttcaacaggtgaaactcaaataacaccacctgctccggggtcaagccgtggtgctgacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgtggctaa

SEQ ID NO: 5698 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5699 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccacccacatatcagatgaagaagcaaacctcttcgccatgcaattagcaaatgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5700 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccacccaaatatcagatgaagaagcaaacctcttcgccattcaattaacaaatgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5701 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagccaacctcttcgccatgcaattagcaagtgcttcagttcttcccatgtttttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5702 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5703 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5704 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5705 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5706 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5707 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5708 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5709 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5710 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5711 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5712 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaattagcaagtgcttcagttcttcccatgattttaaaatcagctcttgaacttgatctcttagaaatcattgctaaagctggacctgatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5713 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5714 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5715 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttattgtttggctactgttgctaa

SEQ ID NO: 5716 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5717 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5718 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 5719 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 5720 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5721 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 5722 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5723 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5724 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5725 - DNA, 364 bp, Artificial
  MsCOMT deletion introduced by TALEN pair MsCOMT_T01.1
tctcacaaaaacctcatcaatcacaaccatgggttcaacaggtgaaactcaaataacaccaacccatatcagatgaagaagcaaacctcttcgccatacaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtacttaacaagatggaaagattcagagactttatggtttggctactgttgctaa

SEQ ID NO: 5726 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5727 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5728 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5729 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5730 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccatgcaattagcaagtgcttcagttcttcccatgattttaaaatcagctcttgaacttgatctcttagaaatcattgctaaagcttgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5731 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgtaccagtcatgttggaccgaatgttgcgtctcttggcttgttacaatatcctcacttgttctgttcgtactcaacaagatggaaaggttcagagactttatggtttggctactgttgctaa

SEQ ID NO: 5732 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5733 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5734 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5735 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5736 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5737 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5738 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaagcaaacctcttccccaatcaactagcaaggggttcagttcttcccatgattttgaaatcagctcttgaacctgaactcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5739 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacatatcagatgaagaaacaaacctcttccccattcaattaacaaatgcttcagttcttcccctgattttaaaatcagcttttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5740 - DNA, 365 bp, Artificial
  MsCOMT deletion introduced by TALEN pair MsCOMT_T01.1
tctcacaaaaacctcatcaatcacaaccatgggttcaacaggtgaaactcaaataacaccaaccacaataccgatgaaaaagcaaaacttttcgccatgcaaataaccaaggcctcaattcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5741 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5742 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5743 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5744 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5745 - DNA, 416 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 5746 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaactagcaagtgcttcagttcttcccatgattttgaaatcagctcttgaacttgatctcttagaaatcattgctaaagcttgacctggtgctcaaatttcacctatttaaattccttctcatctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5747 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5748 - DNA, 416 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 5749 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5750 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5751 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcgtgttacaatatcctcacttgttcagttcgtactcaacaagatggaaaggttcagagactttatggtttggctactgttgctaa

SEQ ID NO: 5752 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 5753 - DNA, 417 bp, Artificial
  MsCOMT deletion introduced by TALEN pair MsCOMT_T01.1
tctcacaaaaacctcatcaatcacaaccatgggttcaacaggtgaaactcaaataacacaggtatcttcgagccagccacgatcgacattgatctggctatcttgctgaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5754 - DNA, 360 bp, Artificial
  MsCOMT deletion introduced by TALEN pair MsCOMT_T01.1
tctcacaaaaacctcatcaatcacaaccatgggttcaacaggtgaaactcaaataacacacatatcagatgaagaagcaaacctcttcgccatgcaattagcaagtgcttcagttcttcccatgattttaaaatcagctcttgaacttgatctcttagagatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5755 - DNA, 360 bp, Artificial
  MsCOMT deletion introduced by TALEN pair MsCOMT_T01.1
tctcacaaaaacctcatcaatcacaaccatgggttcaacaggtgaaactcaaataacacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5756 - DNA, 360 bp, Artificial
  MsCOMT deletion introduced by TALEN pair MsCOMT_T01.1
tctcacaaaaacctcatcaatcacaaccatgggttcaacaggtgaaactcaaataacacacatatcagatgaagaagcaaacctcttcgccatgcaactagcaagtgcttcagttcttcccatgattttgaaatcggctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttagggtttggctactgttgctaa

SEQ ID NO: 5757 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgctatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5758 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5759 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5760 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5761 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5762 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5763 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5764 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5765 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaagttgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5766 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5767 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5768 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 5769 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5770 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5771 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5772 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5773 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5774 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaattagcaagtgcttcagttcttcacatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5775 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactatcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5776 - DNA, 364 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 5777 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5778 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5779 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5780 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5781 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5782 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5783 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5784 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaacttgatctcttagaaatcattgctaaagctggacatggtgctcaaatttcacctattgaaattgcttctcagctaccaacaactaaccctgatgcaccagttatgttggaccgaatgttgcgtctcttggcttgttacaatatcctcacatgttctgttcgtactcaacaagatggaaaggttcagagactttatggtttggctactgttgctaa

SEQ ID NO: 5785 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttgaaatcagctcttgaactggatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5786 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5787 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5788 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5789 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5790 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5791 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5792 - DNA, 365 bp, Artificial
  MsCOMT deletion introduced by TALEN pair MsCOMT_T01.1
tctcacaaaaacctcatcaatcacaaccatgggttcaacaggtgaaactcaaataacacaacccacatatcagataaagaagcaaacctcttctccaaacaactagcaagagcttcagttcttcccatgattttgaaaacagctcttgaacttgagctcttagaaatcattgctaaagctggacattgtgctcaaatttcacctattgaaattgcttctcagctcccaacaactaaccctgattcaccagttatgttggaccgaatgttgcgtctcttggcttgttacaatttcctcacttgttcagttcgtactcaacaagatggaaagtttcagagactttatggtttggctactgttgctaa

SEQ ID NO: 5793 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacctacatatcagatgaagaaacacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5794 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacctctcagatgaagaagcaaccctcttcgccatgcaattagcaagtgcttcagctcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5795 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatctcatatgaagaagcaaacctcttctccatccaactaccaagtacttcagttcttcccatgatttttaaatcagctcttgaacttgatctcttataaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5796 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcagacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5797 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5798 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5799 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcacacctcttcaccatgcaactagcaagtgcttcagttcttcccatgattttgaaatcagctcttgaacttgatctcttagaaatcattgctaaagctggacctgttgctcaactttcacctattgaaattgcttctcagctaccaacaactaaccctgatgcaccagttatgttggaccgaattttgcggctcttggcttgttacagtatcctcacttgttcagttcgtactcaacaagatggaaaggttcagagactttatggtttggctactgttgctaa

SEQ ID NO: 5800 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcaaacctcttcgtcatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5801 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5802 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5803 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5804 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5805 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5806 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5807 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagctgaagaagcaaccctcttcgccatgcaactagcaagtacttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5808 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagctgaagaagcaaaactcttcgccatgcaactagcaacaacttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5809 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5810 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctctttgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5811 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttctccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5812 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5813 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5814 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgtcatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5815 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5816 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttgccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5817 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgatttttaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5818 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5819 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5820 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5821 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5822 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgttaaagctggacctggtgctcaaatttcacctgttcaaattgcttctcagcttccaacaactaaccctgatgcagcagtcatgttggaccgaatgttgcgtctcttggcttgttacaatatcctcacttgttcagttcgtacgcaacaagatggaaaggttcagagcctttagggtttggctactgttgctaa

SEQ ID NO: 5823 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5824 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5825 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5826 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5827 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgctccagttatgttggaccgaatgttgcgtctcttggcttgttacaatatcctcacttgttcagttcgtactcaacaagatggaaagattcagagactttatggtttggctactgttgctaa

SEQ ID NO: 5828 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5829 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5830 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5831 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgcta

SEQ ID NO: 5832 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5833 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 5834 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 5835 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactggtgctaa

SEQ ID NO: 5836 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5837 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5838 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5839 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5840 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 5841 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5842 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttggtacaatatccgcacttgttcaggtcgtactcaacaagatggaaaggttcagagactttagggtttggctactggtgctaa

SEQ ID NO: 5843 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaattagcaagtgcttcagttcttcccatgattttaaaatcagctcttgaacttgatctcttagaaatcattgctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5844 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5845 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5846 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5847 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5848 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctga

SEQ ID NO: 5849 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5850 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5851 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 5852 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5853 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5854 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagcttcagagactttatggtttggctactgttgctaa

SEQ ID NO: 5855 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagccaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5856 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5857 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5858 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5859 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5860 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccatgattttaaaatcagctcttgaacttaatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5861 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcacacctcttcgccatgcaactagcaagtgcttcagttcttcccacgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5862 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5863 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaatctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5864 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttctccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5865 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5866 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5867 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5868 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5869 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5870 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5871 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5872 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccatttatgttggaccgaatgttgcgtctcttggcttgttacaatatcctcacttgttcagttcgtactcaacaagatggaaaggttcagagactttatggtttggctactgttgctaa

SEQ ID NO: 5873 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5874 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 5875 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5876 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5877 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5878 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgggccgaaggttgcagctcttggcttgatacaatatcctcactttttcagttcgtactcaacaagatggaaaggttcagagcctttatggtttggctactgttgctaa

SEQ ID NO: 5879 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5880 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5881 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttagctactgttgctaa

SEQ ID NO: 5882 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5883 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttgaaatcagctcttgaacttgatctcttagaaatcattgctaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5884 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcaggtcttgaacgtgatctcttagaaatcattgctaaagctggacctggtgctcaattttcacctattgaaattgcttctcagctcccaacaactaaccctgatgcaccagttatgttggaccgaatgttgcgtctcttggcttgttacaatatcctcacttgttcagttcgttctcaacaagatggaaagattcagagactttatggtttggctactgttgctaa

SEQ ID NO: 5885 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5886 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgttcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5887 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5888 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtcccttggcttgttacaatatcctcacttgttcagttcgtactcaacaagatggaaaggttcagagactttatggtttggctactgttgctaa

SEQ ID NO: 5889 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5890 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5891 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5892 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcggagactttatggtttggctactgttgctaa

SEQ ID NO: 5893 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5894 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5895 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcttcacttgttcagttcgtactcaacaagatggaaaggttcagagactttatggtttggctactgttgctaa

SEQ ID NO: 5896 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5897 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5898 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5899 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5900 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5901 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 5902 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggagaggttcagagactgtatggtttggcgactgatgctaa

SEQ ID NO: 5903 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaagattcagagactttatggtttggctactgttgctaa

SEQ ID NO: 5904 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttgggttgttacaatatcctcacttgttcagttcgtactcaacaagatggaaagattcagagactttatggtttggctactgttgctaa

SEQ ID NO: 5905 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 5906 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtgacaatatcctcacttgttcagttcgtactcaacaagatggaaagattcagagactttatggtttggcaactgttgataa

SEQ ID NO: 5907 - DNA, 361 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtttaa

SEQ ID NO: 5908 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 5909 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 5910 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5911 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 5912 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 5913 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 5914 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 5915 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctcgttacaatatcctcacttgttcagttcgtactcaacaagatggaaaagttcagagactttatggtttggctactgttgctaa

SEQ ID NO: 5916 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 5917 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgctgcgtctcttggcttgttacaatatcctcacttgttcagttcgtactcaacaagatggaaaggttcagagactttatggtttggctactgttgctaa

SEQ ID NO: 5918 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatggaaaggttcagagactttatggtttggctactgttgctaa

SEQ ID NO: 5919 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggcttggctactgttgctaa

SEQ ID NO: 5920 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatacaccagttatgttgaaccgaatgttgcgtctcttggcttgttacaatatccacacttgttcagttcgtactcaacaagatggaaaggttcagagactttatggtttggctactgttgctaa

SEQ ID NO: 5921 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5922 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5923 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcacaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5924 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctactaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5925 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccggttatgttggaccgaatgttgcgtctcttggcttgttacaatatcctcacttgttcagttcgtactcaacaagatggaaaggttcagagactttatggtttggctactgttgctaa

SEQ ID NO: 5926 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5927 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5928 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5929 - DNA, 360 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctgttgctaa

SEQ ID NO: 5930 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5931 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaagattcagagactttatggtttggctactgttgctaa

SEQ ID NO: 5932 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 5933 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttacggtttggctactgttgctaa

SEQ ID NO: 5934 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatattggaccgaatgttgcgtctcttggcttgttacaatatcctcacttgttcagttcgtactcaacaagatggaaaagttcagagactttatggtttggctactgttgctaa

SEQ ID NO: 5935 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5936 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcccagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5937 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5938 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctactgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5939 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctaaaatttctcctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 5940 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5941 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5942 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5943 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcatgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5944 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagcccttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5945 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagcaagcgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5946 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagaaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5947 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaattagaaagtgcttcagttcttcccatgattttaaaatcagatcttgaacttgatctcttagaaatcattgctaaagctggacctggtgctcaaatttcacctattgaaattgcttctcagatcccaacaactaaccctgatgcaccagttatgttggtcctaatgttgcgtctcttggcttgttacaatatcctcacttgttcagttcgcacccaacaagatggaaaggttcagagcctttatggttttgatcctgtagctaa

SEQ ID NO: 5948 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactgccaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5949 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcggttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5950 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgagcttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5951 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctgttgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5952 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcatctattgaaattgcttctcagctcccaacaactaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5953 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5954 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5955 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 5956 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5957 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 5958 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtacgcaacaagatggaaaggttcagagactttatggtttggctactgttgctaa

SEQ ID NO: 5959 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5960 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 5961 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5962 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5963 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 5964 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttgtggtttggctactgttgctaa

SEQ ID NO: 5965 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 5966 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 5967 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 5968 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 5969 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5970 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5971 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccaattatgttggaccgaatgttgcgtctcttggcttgttacaatatcctcacttgttcagttcgtactcaacaagatggaaaagttcagagactttatggtttggctactgttgctaa

SEQ ID NO: 5972 - DNA, 364 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaataactaaccctgatgcaccagttatgttggaccgaatgttgcgtctcttggcttgttacaatatcctcacttgttcagttcgtactcaacaagatggaaagatttagagactttatgggttggcttactgttgctaa

SEQ ID NO: 5973 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5974 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 5975 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 5976 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtcctcagcaagatggaaaagttcagagcctttagggtttggctactgttgctaa

SEQ ID NO: 5977 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 5978 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctgctgttgctaa

SEQ ID NO: 5979 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcctctcttggcttgttacactatcctcttttgttcagttcgtactcaacaagatggaaaggttcagagactttatggttgggctactgttgaaaa

SEQ ID NO: 5980 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5981 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacgatatcctcacttgttcagttcgtactcaacaagatggaaaggttcagagactttatggtttggctactgttgctaa

SEQ ID NO: 5982 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 5983 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 5984 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgaaaaagttcagagactttatggtttggctactgttgctaa

SEQ ID NO: 5985 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcctgttacaatatcctcacttgttcagttcgtactcaacaagatggaaaggttcagagactttatggtttggctactgttgctaa

SEQ ID NO: 5986 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtttcaatatcctcacttgttcagttcgtactcaacaagatggaaaggttcagagactttatggtttggctactgttgctaa

SEQ ID NO: 5987 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 5988 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctttgcttgttacaatttcctcacttgttcagttcgtactcaacaagatggaaaggttcagagactttatggtttggctacttttgctaa

SEQ ID NO: 5989 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctacggttgctaa

SEQ ID NO: 5990 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaagattcagagactttatggtttggctactgttgctaa

SEQ ID NO: 5991 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 5992 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 5993 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttggtcagttcgtactcaacaagatggaaaagttcagagactttatggtttggctactgttgctaa

SEQ ID NO: 5994 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgtcggaccgaatgttgcgtctcttggcttgttacaatatcctcacttgttcagttcgtactcaacaagatggaaaagttcagagactttatggtttggctactgttgctaa

SEQ ID NO: 5995 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgctggaccgaatgttgcgtctcttggcttgttacaatatcctcacttgttcagttcgtactcaacaagatggaaaggttcagagactttatggtttggctactgttgctaa

SEQ ID NO: 5996 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5997 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgattctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 5998 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatcgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 5999 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacccattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6000 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6001 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgcacaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6002 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6003 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctgatgctcaaatttcacctattgaaattgcttctcagctcccaacaactaaccctgatgcaccagttatgttggaccgtatgttgcgtctcttggcttgttacaatatcctcacttgttcagttcgtactcaacaagatggaaaggttcagagactttatggtttggcgactgttgctaa

SEQ ID NO: 6004 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctgatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6005 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctgcacctggtgctgagatttcccctattgaaattgcttctcatctaccaacaactaaccctgatgcaccagttatgttggaccgaatgttgcgtcacttggcttgttactatatcctcacttgttcagttcgtactcaacaagatggaaaggttcagcgtctttatggtttggcgactgttgctaa

SEQ ID NO: 6006 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6007 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttgaaataagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6008 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatcttttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6009 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 6010 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6011 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6012 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 6013 - DNA, 361 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgca

SEQ ID NO: 6014 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6015 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6016 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6017 - DNA, 362 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctctgttgctaa

SEQ ID NO: 6018 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6019 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 6020 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6021 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6022 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6023 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacattatcctcacttgttcagttcgtactcaacaagatggaaagattcagagactttatggtttggctactgttgctaa

SEQ ID NO: 6024 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6025 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtacgtactcaacaagatggaaagattcagagactttatggtttggctactgttgctaa

SEQ ID NO: 6026 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6027 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcactgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6028 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagtgcttcagttcttcccatgattctgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6029 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaactagcaagagcttcagctcttcccatgattttaaaatcagctcttgaacttgatctcttagtaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6030 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaacaagcaattgcttcagttcttccaatgattttgaaatcagctcttgaacttgatctcttataaatcattgctaaagctggacctcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6031 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccatgcaacaagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6032 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6033 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacctcctcgccatgcaattagcaagcgcttcagttcttcccatgattttaaaatcatctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6034 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacatcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6035 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaagcaaacatcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6036 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccacatatcagatgaagaaacaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6037 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacccaaatatcagaggaagaagcacacctcttcgccatgcaactagcaagtgcttcagttcttcccatgattttgaaatcagctcttgaacttgatctcttagaaatcattgctaaagctggacctggtgctcaaatatcacctattgaaattgcttctcagctaccaccaactaaccctgatgcaccatttattttggaccgtatgtttcgtctcttaacttgccccaagacccgcacgggggcaggacgtactcaacaagatggaaattttccacccctttatggtttggctactgttgctaa

SEQ ID NO: 6038 - DNA, 363 bp, Artificial
  MsCOMT deletion introduced by TALEN pair MsCOMT_T01.1
tctcacaaaaacctcatcaatcacaaccatgggttcaacaggtgaaactcaaataacaaccaacatatcagatgatgaagcagacctcttcgtcatgcaacaagcaacagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6039 - DNA, 359 bp, Artificial
  MsCOMT deletion introduced by TALEN pair MsCOMT_T01.1
tctcacaaaaacctcatcaatcacaaccatgggttcaacaggtgaaactcaaataacaacatatcagatgaagaagcaaacctcttcgccatgcaattagcaagtgcttcaggtcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6040 - DNA, 359 bp, Artificial
  MsCOMT deletion introduced by TALEN pair MsCOMT_T01.1
tctcacaaaaacctcatcaatcacaaccatgggttcaacaggtgaaactcaaataacaacatatcagataaagaagcaaaaatcatagctctgcaataagcaattgcttaagtccttcccatgattttaaaatcagaaattgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6041 - DNA, 363 bp, Artificial
  MsCOMT deletion introduced by TALEN pair MsCOMT_T01.1
tctcacaaaaacctcatcaatcacaaccatgggttcaacaggtgaaactcaaataacaacaaacatatcagatgaagaagcaaaaatcttcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6042 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgctctcactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6043 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgctctcactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6044 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgctctcactaaccaacccacatatcagatgaagaagcaaacctcttcgccatgcaactagcacgtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaaggttcagagcctttatggtttggctactgtggctaa

SEQ ID NO: 6045 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatccgatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6046 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatccgatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6047 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatccgatgaagaagcaaacctcttcgccatgcaattagcaagtgcttcagttcttcccatgattttaaaatcagctcttgaacttgatctcttagaaatcattgctaaagctagacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6048 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcacgtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6049 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6050 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6051 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6052 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagttggaaaggttcagagactttatggtttggctactgttgctaa

SEQ ID NO: 6053 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6054 - DNA, 414 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttgctactgttgctaa

SEQ ID NO: 6055 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6056 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6057 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6058 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaattagcaagtgcttcagttcttcccatgattttaaaatcagctcgttaacttgatctcttagaaatcattgctaaagctggacctggtgctcaaatttcacctatttaaaatgcttctcagctcccaacaactaaccctgatgccccaggtatgttggaacgaatgttgcgtctcttggcttgttacaatatcctcacttgttcagttcgttctcaacaagatggaaagattcagagactttatggtttggctactgttgctaa

SEQ ID NO: 6059 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 6060 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6061 - DNA, 415 bp, Artificial
  MsCOMT deletion introduced by TALEN pair MsCOMT_T01.1
tctcacaaaaacctcatcaatcacaaccatgggttcaacaggtgaaactcaaataacaaactcttcctggctagcggtacgcgtattaattgcgttgcgctcactaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6062 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatattagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6063 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6064 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6065 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccattcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6066 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggactgaatgttgcgtctcttggcttgttacaatatcctcacttgttcagttcgtactcaacaagatggaaagattcagagactttatggtttggctactgttgctaa

SEQ ID NO: 6067 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6068 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6069 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6070 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6071 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6072 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6073 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 6074 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6075 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6076 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6077 - DNA, 363 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctacgttgctaa

SEQ ID NO: 6078 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagccaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6079 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccattcagttagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 6080 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccattcaattagcaagtgcttcagttcttctcatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6081 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6082 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6083 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6084 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6085 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6086 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6087 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6088 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6089 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6090 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6091 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6092 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6093 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6094 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6095 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttgaaatcagctcttgaacttgatctcttagaaatcattgctaaagctggacctggtgctcaaattacacctattgaaattgcttctcagctaccaacaactaaccctgatgcaccagttatgttggaccgaatgttgcgtctcgtggcttgttacaatatcctcacttgttcagttcgtactcaacaagatggaaagattcagagactttatggtttggctactgttgctaa

SEQ ID NO: 6096 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6097 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 6098 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagacgttatggtttggctactgttgctaa

SEQ ID NO: 6099 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6100 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6101 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6102 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 6103 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6104 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggtacagagactttatggtttggctactgttgctaa

SEQ ID NO: 6105 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 6106 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6107 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6108 - DNA, 363 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttgctactgttgctaa

SEQ ID NO: 6109 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 6110 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6111 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6112 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattgctaaagctggacctagtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6113 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaattagcaagtgcttcagttcttcccatgattttaaaatcagctcttgaacttgatctcttagaaatcattactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6114 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgttcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6115 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 6116 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6117 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6118 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6119 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6120 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6121 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6122 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatattctcacttgttcagttcgtactcaacaagatggaaaggttcagagactttatggtttggctactgttgctaa

SEQ ID NO: 6123 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6124 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6125 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgctcaaagttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6126 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6127 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6128 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6129 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccatttatattggaccgaatgttgcgtctcttggcttgttacaatatcctcacttgttcatttcgtactcaacaagatggaaagattcagagactttatggtttggctactgttgctaa

SEQ ID NO: 6130 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6131 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6132 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6133 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 6134 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaagtgcttcagttcttcccatgattttaaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6135 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaacccacatatcagatgaagaagcaaacctcttcgccatgcaactagcaaaagcttctgttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6136 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaaaccccatatcagatgtagaagacaaaatcttcgccatgcgactagcaaaagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6137 - DNA, 364 bp, Artificial
  MsCOMT deletion introduced by TALEN pair MsCOMT_T01.1
tctcacaaaaacctcatcaatcacaaccatgggttcaacaggtgaaactcaaataacaaaaacacatataagatgtaaaagaaaaaatctccgccatacaataagaaaaagcttcagttcttcccatgattttaaaatcagctcttgaacatgatatcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6138 - DNA, 361 bp, Artificial
  MsCOMT deletion introduced by TALEN pair MsCOMT_T01.1
tctcacaaaaacctcatcaatcacaaccatgggttcaacaggtgaaactcaaataaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6139 - DNA, 361 bp, Artificial
  MsCOMT deletion introduced by TALEN pair MsCOMT_T01.1
tctcacaaaaacctcatcaatcacaaccatgggttcaacaggtgaaactcaaataaatccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 6140 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagattaagaagcaaacctcttcgccatgccactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6141 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagattaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6142 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 6143 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6144 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6145 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6146 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6147 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6148 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6149 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 6150 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6151 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6152 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttacgtctcttggcttgttacaatatcctcacttgttcagttcgtactcaacaagatggaaaagttcagagactttatggtttggctactgttgctaa

SEQ ID NO: 6153 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcggttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6154 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcatttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6155 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6156 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6157 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6158 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6159 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6160 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaaaatcctcacttgttcagttcgtactcaacaagatggaaaggttcagagactttatggtttggctactgttgctaa

SEQ ID NO: 6161 - DNA, 352 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 6162 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6163 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6164 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6165 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggcgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6166 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6167 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6168 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6169 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6170 - DNA, 353 bp, Artificial
  MsCOMT deletion introduced by TALEN pair MsCOMT_T01.1
tctcacaaaaacctcatcaatcacaaccatgggttcaacaggtgaaactcaaataaatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6171 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacgtatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6172 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacgtatcagatgaagaagcaaacctcttcgccatgcaactagcaagtgcttcagttcttcccatgattttgaaatcagctcttgaacttgatctcttagaaatcattgctaaagcttgacctggtggtcaaatttcacctattgaaattgcttttcagctaccaacaactaaccctgatgcaccagttatgttggacagattgtttcgtctcttggcttgttacaatatcctcactttttcagttagtaaccaaccagattgaaaggttcagagactttatggtttggctactgttgctaa

SEQ ID NO: 6173 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatttcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6174 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatctcagatgaagaagcaaacctcttcgccatgcaactcgcaagggcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6175 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatctgatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6176 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatctgatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtcccttggcttgttacaatatcctcacttgttcagttcgtactcaacaagatggaaaggttcagagactttatggtttggctactgttgctaa

SEQ ID NO: 6177 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6178 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcatatgaagaagcaaagcacttctccatgcaattaacaaggcattcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6179 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6180 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaggaagcaaacctcttcgccatgcaattagcaagtccatcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6181 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaggaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6182 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagtagcaaacctcttcgccatgcaactagcatgtccttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6183 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaaggagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6184 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagcagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcggctcttggctttttacaatatcctcacttgttcagttcgtactcaacaagatggaaaggttcagagactttatggtttggctactgttgctaa

SEQ ID NO: 6185 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaggcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6186 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcatacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6187 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6188 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaaccttttcgccatgcaactagcaagtgcttcagttcttcccatgattttgaaatcagctcttgaacttgatctcttagaaatcattgctaaagctggacctggtgctcaaatttcacctcttgaaattgcttctcagctaccaacaactaaccctgatgcaccatttatgttggaccgaatgttgcgtctcttggcttgttacaatatcctcacttgttcagttcgtactcaacaagatggaaaggttcagagactttatggtttggctactgttgctaa

SEQ ID NO: 6189 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6190 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttctccatgcaactagcaagtccttcacttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6191 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6192 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6193 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6194 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgccactagcaagtgcttcagttcttcccatgcttttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6195 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcatctagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6196 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcagttagcaagtgcttcagttcttcccatgattttagaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6197 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctcccaactactaaccctgatgcaccagttatgttggaccgaatgttgcgtctcttggcttgttacaatatcctcacttgttcagttcgtactcaacaagatggaaaggttcagagactttatggtttggctactgtagctaa

SEQ ID NO: 6198 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagccagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6199 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6200 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6201 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcggttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6202 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccttgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6203 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatggttttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6204 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgcttttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6205 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaactttatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaatattcagagactttattgtttggctactgttactaa

SEQ ID NO: 6206 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggaccttgtggtcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6207 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtagctaa

SEQ ID NO: 6208 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttctcctattgaaattgcttctcagctcccaacaactaaccctgatgcaccagttatgtgggaccgaatattgcgtctcttggcttgttacaatatcctcacttgttcagttcgtactcaacaagatggaaaggttcagagactttatggtttggatactgttgctaa

SEQ ID NO: 6209 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6210 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6211 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6212 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6213 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6214 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6215 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6216 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6217 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6218 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6219 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6220 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 6221 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgccaa

SEQ ID NO: 6222 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6223 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 6224 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctgctgttgctaa

SEQ ID NO: 6225 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttaagttcgtactcaacaagatggaaagattcagagactttatggtttggctctgttgctaa

SEQ ID NO: 6226 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaattttgcgtctcttggcttgttacaatatcctcacttgttcagttcgtactcaacaagatggaaaggttcagagactttatggtttggctactgttgctaa

SEQ ID NO: 6227 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6228 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6229 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6230 - DNA, 359 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctacttgctaa

SEQ ID NO: 6231 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 6232 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcttcacttgttcagttcgtactcaacaagatggaaaggttcagagactttatggtttggctactgttgctaa

SEQ ID NO: 6233 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctag

SEQ ID NO: 6234 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 6235 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactggtgctaa

SEQ ID NO: 6236 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6237 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacgaaccctgatgcaccagttatgttggaccgaatgttgcgtctcttggcttgttacaatatcctcacttggtcagttcgtactcaacaagatggaaaggttcagagactttatggtttggctactgttgctaa

SEQ ID NO: 6238 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaaaaactaaccctgatgcaccagttatgttggaccgaatgttgcgtcgcttggcttgttacaatatcctcgcttgttcagttcgtactcaacaagatggaaagattcagagactttatggtttggctactgttgcgaa

SEQ ID NO: 6239 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6240 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctgcacctggtgctcaaatttcacctattgaaattgcttctcagctcccaacaactaaccctgatgcaccagttatgttggaccgaatgttgcgtctcttggcttgttacaatatcctctctttttcagttcgtactcaacaagatggaaaggttcagagactttatggtttggctactgttgctaa

SEQ ID NO: 6241 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgccaaagctggacctggtgctcaaatttcacctattgaaattgcttctcagctaccaacaactaaccctgatgcaccagttatgttggaccgaatgttgcgtcacgtggcttgttacaatatcctcacttgttcagttcgtactcaaaaagatggaaaggttcagagactttatggtttggctactgttgctaa

SEQ ID NO: 6242 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6243 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6244 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaagtcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6245 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcgttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6246 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6247 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6248 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctacagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctacgttgctaa

SEQ ID NO: 6249 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctacagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6250 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6251 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6252 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctacagctggacctggtgctcaaatttcacctattgaaattgcttctcagctcccaacaactaaccctgatgcaccagttatgctggaccgaatgttgcgtctcttggcttgttacaatatcctcacttgttcagttcgtactcaacaagatggaaagattcagagactttatggtttggctactgttgctaa

SEQ ID NO: 6253 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6254 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaacgctggacctggtgctcaaatttcacctattgaaattgcgtctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6255 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggaccttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttactaa

SEQ ID NO: 6256 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccttttgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6257 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6258 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6259 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatgggaagattcagagactttatggtttggctactgttgctaa

SEQ ID NO: 6260 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6261 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6262 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6263 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctacagttgctaa

SEQ ID NO: 6264 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 6265 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 6266 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgaagcaccagacatgttgaaccgaatgttgcgtctcttggcttgttacaatatcctcacttgttcagttcgtactcaacaagatggaaaggttcagagactttatggtttggctactgttgctaa

SEQ ID NO: 6267 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6268 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6269 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 6270 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6271 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6272 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6273 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6274 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttgtcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6275 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6276 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcccttgttcagttcgtactcaacaagatggaaaagttcagagactttatggtttggctactgttgctaa

SEQ ID NO: 6277 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6278 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggataggttcagagactttatggtttggctactgttgctaa

SEQ ID NO: 6279 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6280 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6281 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 6282 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6283 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcactagttatgttggaccgaatgttgcgtctcttggcttgttacaatatcctcacttgttcagttcgtactcaacaagatggaaaggttcagagactttatggtttggctactgttgctaa

SEQ ID NO: 6284 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6285 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatccgcacttgttcagttcgtactcaacaagatggaaagattcagagactttatggtttggctactgttgctaa

SEQ ID NO: 6286 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 6287 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6288 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6289 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaaggtggaaagattcagagactttatggtttggctactgttgctaa

SEQ ID NO: 6290 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6291 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctagttacaatatcctcacttgttcagttcgtactcaacaagatggaaacattcagagactttatggtttggctactgttgctaa

SEQ ID NO: 6292 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 6293 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagattttatggtttggctactgttgctaa

SEQ ID NO: 6294 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 6295 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 6296 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatgggttggctactgttgctaa

SEQ ID NO: 6297 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcggctcttggcttgttacaatatcctcacttgttcagttcgtactcaacaagatggaaaggttcagagacttgatggtttggctactgttgctaa

SEQ ID NO: 6298 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

(The sequence listing continues in the following parts.)

What is claimed is:

1. An alfalfa plant, a plant part of said alfalfa plant, or a plant cell of said alfalfa plant, wherein the genome of said alfalfa plant, said plant part, or said plant cell comprises an induced mutation in one or more of four COMT alleles of said genome, wherein the induced mutation comprises a deletion of at least 5 consecutive nucleic acid base pairs within a nucleic acid sequence selected from the group consisting of (a) the nucleic acid sequence as set forth in SEQ ID NO:6 and (b) a nucleic acid sequence having at least 95% nucleic acid sequence identity to the nucleic acid sequence as set forth in SEQ ID NO:6, with one or more rare-cutting endonucleases targeted to the SEQ ID NO:6 or said nucleic acid sequence having at least 95% nucleic acid sequence identity to the SEQ ID NO:6, and wherein the at least 5 consecutive nucleic acid base pairs include a deletion of the cytosine at position 29 of SEQ ID NO: 1.

2. The alfalfa plant, plant part, or plant cell of claim 1, wherein said plant part comprising said induced mutation is selected from the group consisting of a stem, a leaf, a flower, and a seed.

3. The alfalfa plant, plant part, or plant cell of claim 1, wherein said plant cell comprising said induced mutation is an isolated alfalfa plant cell.

4. The alfalfa plant, a plant part of said alfalfa plant, or a plant cell of said alfalfa plant of claim 1, wherein said deletion of at least 5 consecutive nucleic acid base pairs is a deletion of 5 to 13 consecutive nucleic acid base pairs.

* * * * *